US012473363B2

(12) United States Patent
Capon

(10) Patent No.: US 12,473,363 B2
(45) **Date of Patent: *Nov. 18, 2025**

(54) NK/MONOCYTE ENGAGERS

(71) Applicant: Biomolecular Holdings LLC, Burlingame, CA (US)

(72) Inventor: Daniel J. Capon, Hillsborough, CA (US)

(73) Assignee: BIOMOLECULAR HOLDINGS LLC

( * ) Notice: Subject to any disclaimer, the term of this patent is extended or adjusted under 35 U.S.C. 154(b) by 0 days.

This patent is subject to a terminal disclaimer.

(21) Appl. No.: 19/050,008

(22) Filed: Feb. 10, 2025

(65) Prior Publication Data

US 2025/0179183 A1 Jun. 5, 2025

Related U.S. Application Data

(63) Continuation of application No. 18/949,940, filed on Nov. 15, 2024, which is a continuation-in-part of application No. 18/188,412, filed on Mar. 22, 2023, which is a continuation-in-part of application No. 18/153,840, filed on Jan. 12, 2023.

(60) Provisional application No. 63/434,866, filed on Dec. 22, 2022, provisional application No. 63/322,594, filed on Mar. 22, 2022, provisional application No. 63/298,999, filed on Jan. 12, 2022.

(51) Int. Cl.

| | |
|---|---|
| ***C07K 16/28*** | (2006.01) |
| ***A61K 39/395*** | (2006.01) |
| ***A61P 35/02*** | (2006.01) |
| ***C07K 16/24*** | (2006.01) |
| ***C07K 16/40*** | (2006.01) |
| *A61K 39/00* | (2006.01) |

(52) U.S. Cl.

CPC ........ *C07K 16/2818* (2013.01); *C07K 16/244* (2013.01); *C07K 16/2803* (2013.01); *C07K 16/2827* (2013.01); *C07K 16/2878* (2013.01); *C07K 16/2896* (2013.01); *C07K 16/40* (2013.01); *A61K 2039/505* (2013.01); *C07K 2317/31* (2013.01); *C07K 2317/35* (2013.01); *C07K 2317/76* (2013.01); *C07K 2317/92* (2013.01)

(58) Field of Classification Search

None

See application file for complete search history.

(56) References Cited

U.S. PATENT DOCUMENTS

| | | | |
|---|---|---|---|
| 7,658,921 | B2 | 2/2010 | Dall'Acqua |
| 7,695,936 | B2 | 4/2010 | Carter |
| 8,216,574 | B2 | 7/2012 | Stavenhagen |
| 8,388,955 | B2 | 3/2013 | Lazar |
| 8,444,973 | B2 | 5/2013 | Tedder |
| 8,546,543 | B2 | 10/2013 | Lazar |
| 8,586,713 | B2 | 11/2013 | Davis |
| 8,679,492 | B2 | 3/2014 | Blein |
| 8,796,424 | B2 | 8/2014 | Croasdale |
| 8,969,526 | B2 | 3/2015 | Bachner |
| 9,353,187 | B2 | 5/2016 | Lazar |
| 9,725,503 | B2 | 8/2017 | Capon |
| 10,011,660 | B2 | 7/2018 | Tsui |
| 10,428,332 | B2 | 10/2019 | Capon |
| 10,968,263 | B2 | 4/2021 | Capon |
| 11,066,459 | B2 | 7/2021 | Capon |
| 11,116,840 | B2 | 9/2021 | Carter |
| 11,198,732 | B2 | 12/2021 | Liu |
| 11,220,556 | B2 | 1/2022 | Capon |
| 2009/0162359 | A1 | 6/2009 | Klein |
| 2010/0239633 | A1 | 9/2010 | Strome |
| 2011/0287009 | A1 | 11/2011 | Scheer |
| 2012/0237506 | A1 | 9/2012 | Bossenmaier |
| 2013/0058937 | A1 | 3/2013 | Auer |
| 2013/0156765 | A1 | 6/2013 | Block |
| 2014/0072582 | A1 | 3/2014 | Block |
| 2014/0286934 | A1 | 9/2014 | Blein |
| 2014/0302037 | A1 | 10/2014 | Borges |
| 2016/0075785 | A1 | 3/2016 | Ast |
| 2016/0229913 | A1 | 8/2016 | Bosques |
| 2016/0289341 | A1 | 10/2016 | Wu |

(Continued)

FOREIGN PATENT DOCUMENTS

WO WO 2020/014429 A2 1/2020

OTHER PUBLICATIONS

Donoghue et al. "A Novel Angiotensin-Converting Enzyme-Related Carboxypeptidase (ACE2) Converts Angiotensin I to Angiotensin I-9", *Circulation Research*, 2000; 87: e1-e9 (Sep. 1, 2000).

Yan et al. "Structural basis for the recognition of SARS-CoV-2 by full-length human ACE2", *Science*, 367: 1444-1448 (Mar. 27, 2020).

Merchant et al. "An efficient route to human bispecific IgG", *Nature Biotech*., 16: 677-681 (Jul. 1998).

Gunasekaran et al. "Enhancing Antibody Fc Heterodimer Formation through Electrostatic Steering Effects", *J. Biol. Chem*., 285 (25): 19637-19646 (Jun. 18, 2010).

Von Kreudenstein et al. "Improving biophysical properties of a bispecific antibody scaffold to aid developability", *mAbs*, 5(5): 646-654 (Sep./Oct. 2013).

Spiess et al. "Alternative molecular formats and therapeutic applications for bispecific antibodies", *Molecular Immunology*, 67: 95-106 (2015).

(Continued)

*Primary Examiner* — Ilia I Ouspenski

(74) *Attorney, Agent, or Firm* — John P. White

(57) ABSTRACT

This invention provides a tetrahedral antibody comprising a first domain, a second domain, a third domain, a fourth, a fifth domain, and a sixth domain, wherein the first domain and the second domain are each a Fc domain of an IgG antibody, wherein the third domain and the fourth domain are each a Fab domain of an anti-CD20 antibody wherein the fifth domain and the sixth domain are each a Fab domain of an anti-CD-19 antibody. This invention also provides methods of producing the tetrahedral antibody of the invention, pharmaceutical compositions comprising the tetrahedral antibody of the invention, and methods of treating B cell cancer, inflammatory disease, and B cell disease by administering the pharmaceutical compositions of the invention.

13 Claims, 128 Drawing Sheets

Specification includes a Sequence Listing.

(56) References Cited

U.S. PATENT DOCUMENTS

| | | | | |
|---|---|---|---|---|
| 2018/0177873 | A1 | 6/2018 | Carter | |
| 2018/0334514 | A1 | 11/2018 | Wright | |
| 2022/0025071 | A1 | 1/2022 | Capon | |
| 2023/0220115 | A1 | 7/2023 | Capon | |
| 2023/0220116 | A1 * | 7/2023 | Capon | C07K 16/2803 424/134.1 |
| 2024/0158526 | A1 * | 5/2024 | Capon | C07K 16/18 |
| 2025/0084169 | A1 * | 3/2025 | Capon | C07K 16/2803 |
| 2025/0092160 | A1 * | 3/2025 | Capon | C07K 16/2809 |

OTHER PUBLICATIONS

Xu et al. "Production of bispecific antibodies in 'knobs-into-holes' using a cell-free expression system", *mAbs*, 7(1): 231-242 (Jan./Feb. 2015).

Shan et al. "Generation and Characterization of an IgG4 Monomeric Fc Platform", *PLOS ONE*, DOI: 10.1371/journal.pone.0160345 (Aug. 1, 2016).

Brinkmann and Kontermann. "The making of bispecific antibodies", *mAbs*, 9(2): 182-212 (2017).

Zhang et al. "Collectrin, a Collecting Duct-specific Transmembrane Glycoprotein, Is a Novel Homolog of ACE2 and Is Developmentally Regulated In Embryonic Kidneys", *J. Biol. Chem.*, 276(20): 17132-17139 (May 18, 2001).

Liu et al. "Novel ACE2-Fc chimeric fusion provides long-lasting hypertension control and organ protection in mouse models of systemic renin angiotensin system activation", *Kidney International*, 94(1): 114-125 (Jul. 2018).

Natarajan et al. (Apr. 2015) "Immunoglobulin superfamily", In: eLS. John Wiley & Sons, Ltd: Chichester, DOI: 10.1002/9780470015902.a0000926.pub2.

Steel et al. "Interleukin-15 biology and its therapeutic implications in cancer", *Trends Pharmacol. Sci.*, 33(1): 35-41 (Jan. 2012).

Perera et al. "The role of interleukin-15 in inflammation and immune repsonses to infection: implications for its therapeutic use", *Microbes Infect.*, 14(3): 247-261 (Mar. 2012).

Locksley et al. "The TNF and TNF Receptor Superfamilies: Integrating Mammalian Biology", *Cell*, 104: 487-501 (Feb. 23, 2001).

Waldmann, T.A. "The biology of interleukin-2 and interleukin-15: implications for cancer therapy and vaccine design", *Nature Reviews Immunology*, 6: 595-601 (Aug. 2006).

Cao and Suresh. "Biospecific Antibodies as Novel Bioconjugates", Bioconjugate Chem., 9(6): 635-644 (Nov./Dec. 1998).

Thakur and Lum. "Cancer therapy with bispecific antibodies: Clinical experience", *Curr. Opin. Mol. Ther.*, 12(3): 340-349 (Jun. 2010).

Doppalapudi et al. "Chemical generation of bispecific antibodies", *Proc. Nat'l. Acad. Sci. USA*, 107(52): 22611-22616 (Dec. 28, 2010).

Ellerman and Scheer. "Generation of Bispecific Antibodies by Chemical Conjugation", In: Kontermann R. (eds). *Bispecific Antibodies*. Springer, Berlin, Heidelberg, DOI: https://doi.org/10.1007/978-3-642-20910-9_3 (Jul. 1, 2011).

Zhang et al. "Anti-CD20 Antibody with Multimerized Fc Domains: A Novel Strategy To Deplete B Cells and Augment Treatment of Autoimmune Disease", *Journal of Immunology*, 196 (3): 1165-1176 (Feb. 1, 2016).

Chan et al. "Variable region domain exchange in human IgGs promotes antibody complex formation with accompanying structural changes and altered effector functions", *Molecular Immunology*, 41: 527-538 (2004).

Schaefer et al. "Immunoglobulin domain crossover as a generic approach for the production of bispecific IgG antibodies", *Proc. Nat'l. Acad. Sci. USA*, 108(27): 11187-11192 (2011).

Klein et al. "The use of CrossMAb technology for the generation of bi- and multispecific antibodies", *mAbs*, 8(6): 1010-1020 (2016).

Regula et al. "Variable heavy-variable light domain and Fab-arm CrossMabs with charged residue exchanges to enforce correct light chain assembly", *Protein Engineering, Design & Selection*, 31(7-8): 289-299 (2018).

Klein et al. "Engineering therapeutic bispecific antibodies using CrossMab technology", *Methods*, 154: 21-31 (2019).

Reff, Mitchell E., et al. "Depletion of B cells in vivo by a chimeric mouse human monoclonal antibody to CD20." (1994): 435-445.

Anderson, D. R., et al. "Targeted anti-cancer therapy using rituximab, a chimaeric anti-CD20 antibody (IDEC-C2B8) in the treatment of non-Hodgkin's B-cell lymphoma." *Biochemical Society Transactions* 25.2 (1997): 705-708.

Maloney, David G., et al. "IDEC-C2B8 (Rituximab) anti-CD20 monoclonal antibody therapy in patients with relapsed low-grade non-Hodgkin's lymphoma." *Blood, The Journal of the American Society of Hematology* 90.6 (1997): 2188-2195.

Eisenberg, Robert. "Rituximab in lupus" *Arthritis Res Ther* (2003): 5:157-159 (DOI 10.1186/ar759).

Anolik, Jennifer, Iñaki Sanz, and R. John Looney. "B cell depletion therapy in systemic lupus erythematosus." *Current rheumatology reports* 5.5 (2003): 350-356.

Gorman, Claire, Maria Leandro, and David Isenberg. "B cell depletion in autoimmune disease." *Arthritis Res Ther* 5.Suppl 4 (2003): S17.

Uchida, Junji, et al. "The innate mononuclear phagocyte network depletes B lymphocytes through Fc receptor-dependent mechanisms during anti-CD20 antibody immunotherapy." *The Journal of experimental medicine* 199.12 (2004): 1659-1669.

Bour-Jordan, Hélène, and Jeffrey A. Bluestone. "B cell depletion: a novel therapy for autoimmune diabetes ?. " *The Journal of clinical investigation* 117.12 (2007): 3642-3645.

Hauser, Stephen L., et al. "B-cell depletion with rituximab in relapsing-remitting multiple sclerosis." *New England Journal of Medicine* 358.7 (2008): 676-688.

Barr, Tom A., et al. "B cell depletion therapy ameliorates autoimmune disease through ablation of IL-6-producing B cells." *Journal of Experimental Medicine* 209.5 (2012): 1001-1010.

Leandro, Maria J. "B-cell subpopulations in humans and their differential susceptibility to depletionwith anti-CD20 monoclonal antibodies." *Arthritis research & therapy* 15.Suppl 1 (2013): S3.

Gelfand, Jeffrey M., Bruce AC Cree, and Stephen L. Hauser. "Ocrelizumab and other CD20+ B-cell-depleting therapies in multiple sclerosis." *Neurotherapeutics* 14.4 (2017): 835-841.

Dubey, Divyanshu, et al. "B-cell-targeted therapies in relapsing forms of MS." *Neurology: Neuroimmunology & Neuroinflammation* 4.6 (2017); e405.

Rubin, Samuel JS, Michelle S. Bloom, and William H. Robinson. "B cell checkpoints in autoimmune rheumatic diseases." *Nature Reviews Rheumatology* 15.5 (2019): 303-315.

Chu, Charles C., et al. "Anti-CD20 therapy reliance on antibody-dependent cellular phagocytosis affects combination drug choice." *Blood* 134 (2019): 682.

Crickx, Etienne, et al. "Anti-CD20-mediated B-cell depletion in autoimmune diseases: successes, failures and future perspectives." *Kidney international* 97.5 (2020): 885-893.

Nissimov, Nitzan, et al. "B cells reappear less mature and more activated after their anti-CD20-mediated depletion in multiple sclerosis." *Proceedings of the National Academy of Sciences* 117.41 (2020): 25690-25699.

Gupta, Sasha, and Scott S. Zamvil. "Can Systemic Anti-CD20 B Cell-Depleting Antibodies Eliminate Meningeal Follicles in Multiple Sclerosis ?. " *Neurology: Neuroimmunology & Neuroinflammation* 8.4 (2021): e1000.

Miyazaki, Yusei, and Masaaki Niino. "B-cell depletion therapy for multiple sclerosis." *Immunological medicine* 45.2 (2022): 54-62.

Bar-Or, Amit, et al. "Clinical perspectives on the molecular and pharmacological attributes of anti-CD20 therapies for multiple sclerosis." *CNS drugs* 35.9 (2021): 985-997.

Galati, Alexandra, Thomas McElrath, and Riley Bove. "Use of B-cell-depleting therapy in women of childbearing potential with multiple sclerosis and neuromyelitis optica spectrum disorder." *Neurology: Clinical Practice* 12.2 (2022): 154-163.

Massacesi, Luca, Alice Mariottini, and Ferdinando Nicoletti. "Relevance of pathogenetic mechanisms to clinical effectiveness of B-cell-depleting monoclonal antibodies in multiple sclerosis." *Journal of Clinical Medicine* 11.15 (2022): 4288.

(56) References Cited

OTHER PUBLICATIONS

Zhang, Zheng, Qian Xu, and Liang Huang. "B cell depletion therapies in autoimmune diseases: Monoclonal antibodies or chimeric antigen receptor-based therapy ?. " *Frontiers in Immunology* 14 (2023): 1126421.

Merchant, A. Margaret, et al. "An efficient route to human bispecific lgG." *Nature biotechnology* 16.7 (1998): 677-681.

Yazawa, Norihito, et al. "Immunotherapy using unconjugated CD19 monoclonal antibodies in animal models for B lymphocyte malignancies and autoimmune disease." *Proceedings of the National Academy of Sciences* 102.42 (2005): 15178-15183.

Dall'Acqua, William F., Peter A. Kiener, and Herren Wu. "Properties of human IgG1s engineered for enhanced binding to the neonatal Fc receptor (FcRn)." *Journal of Biological Chemistry* 281.33 (2006): 23514-23524.

Zalevsky, Jonathan, et al. "The impact of Fc engineering on an anti-CD19 antibody: increased Fcy receptor affinity enhances B-cell clearing in nonhuman primates." *Blood, The Journal of the American Society of Hematology* 113.16 (2009): 3735-3743.

Tedder, Thomas F. "CD19: a promising B cell target for rheumatoid arthritis." *Nature Reviews Rheumatology* 5.10 (2009): 572-577.

Zalevsky, Jonathan, et al. "Enhanced antibody half-life improves in vivo activity." *Nature biotechnology* 28.2 (2010): 157-159.

Mei, Henrik E., Stefanie Schmidt, and Thomas Dörner. "Rationale of anti-CD19 immunotherapy: an option to target autoreactive plasma cells in autoimmunity." *Arthritis research & therapy* 14.Suppl 5 (2012): S1.

Liu, Zhi, et al. "Asymmetrical Fc engineering greatly enhances antibody-dependent cellular cytotoxicity (ADCC) effector function and stability of the modified antibodies." *Journal of Biological Chemistry* 289.6 (2014): 3571-3590.

Dillon, Michael, et al. "Efficient production of bispecific IgG of different isotypes and species of origin in single mammalian cells." *MAbs*. Vol. 9. No. 2. Taylor & Francis, 2017.

Borrok, M. Jack, et al. "An "Fc-Silenced" lgG1 format with extended half-life designed for improved stability." *Journal of Pharmaceutical Sciences* 106.4 (2017): 1008-1017.

Schlothauer, Tilman, et al. "Novel human IgG1 and IgG4 Fc-engineered antibodies with completely abolished immune effector functions." *Protein Engineering, Design and Selection* 29.10 (2016): 457-466.

Wilkinson, Ian, et al. "Fc-engineered antibodies with immune effector functions completely abolished." *PLoS One* 16.12 (2021): e0260954.

Capon et al., "Abstract 2730: Beyond antibodies and CAR-T: Topologically-engineered, super-dimeric antibody-like molecules with dual Fc domains for trispecific, bivalend targeting of CD19, CD20, and Fcgamma receptors". *Cancer Res* (Mar. 22, 2024) 84 (6_supplement): 2730.

Capon et al., "2730 / 21: Beyond antibodies and CAR-T: Topologically-engineered, super-dimeric antibody-like molecules with dual Fc domains for trispecific, bivalend targeting of CD19, CD20, and Fcgamma receptors". *AACR Annual Meeting Abstract* (Apr. 8, 2024).

Capon et al., "2730 / 21: Beyond antibodies and CAR-T: Topologically-engineered, super-dimeric antibody-like molecules with dual Fc domains for trispecific, bivalend targeting of CD19, CD20, and Fcgamma receptors". *AACR Annual Meeting Poster Presentation* (Presented Apr. 8, 2024).

Lewis et al. " Anti-CD19/CD20 bispecific antibody with dual Fc domains mediates enhanced effector functions and durable depletion of memory B cells in vivo". *Scientific Reports* (2025) 15:31562 (published online Aug. 14, 2025).

Capon et al. "Topologically engineered antibodies and Fc-fusion proteins: a new class of multifunctional therapeutic candidates for SARS-CoV-2, cancer, and other disease" bioRxiv preprint posted Mar. 23, 2022.

* cited by examiner

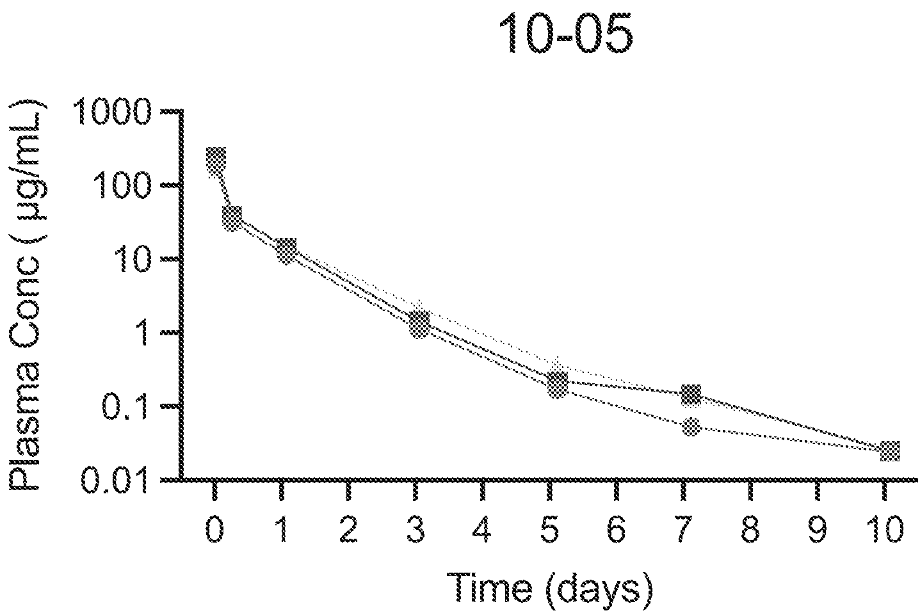
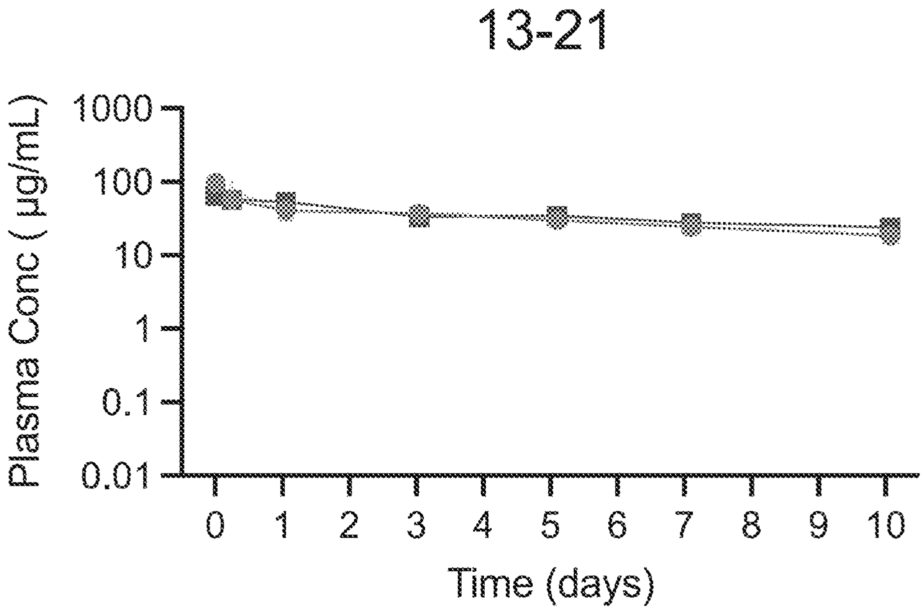
Figure 46

Supplemental Figures

A
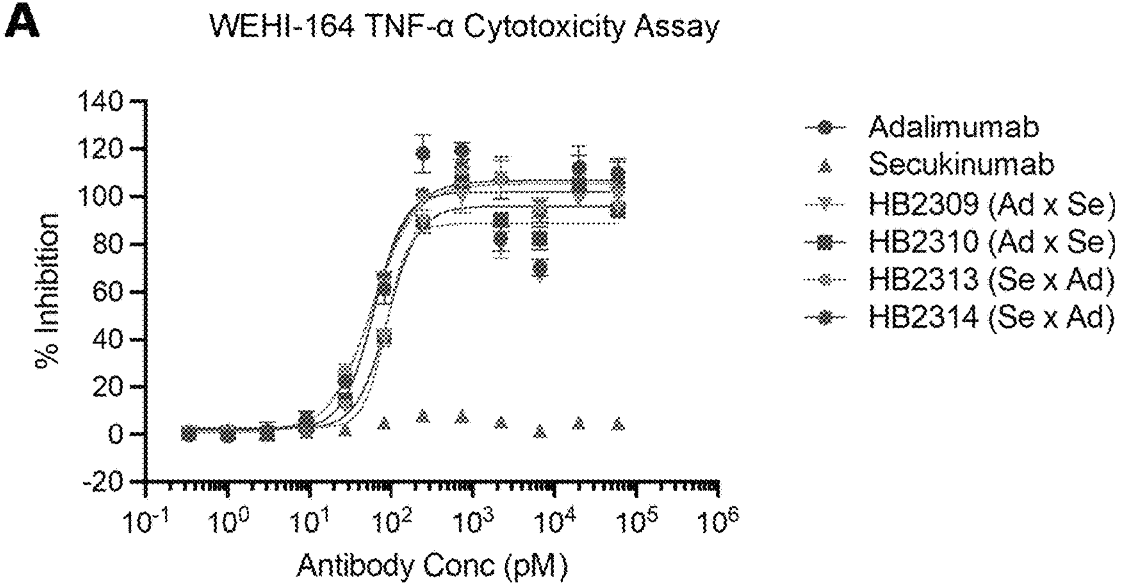
B
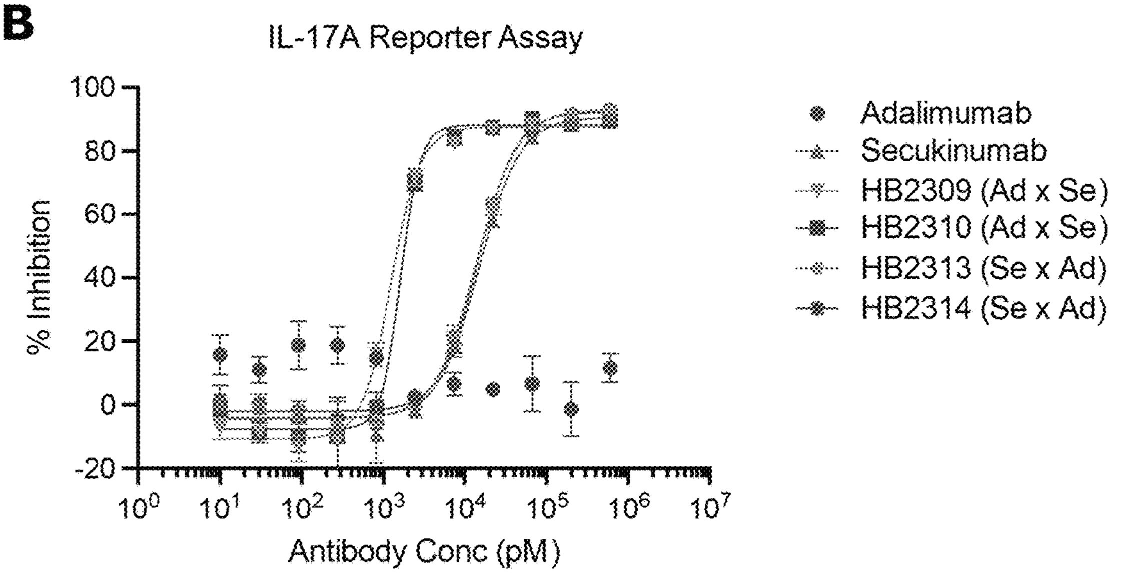
Figure 82

| Structure | Untreated | | IdeZ-treated | | IdeZ-treated/TCEP-reduced | | | |
|---|---|---|---|---|---|---|---|---|
| | Peak 1 Molar Mass | | Peak 2 Molar Mass | | Peak 3 Molar Mass | | Peak 4 Molar Mass | |
| | Experimental (kDa) | Theoretical (kDa) | Experimental (kDa) | Theoretical (kDa) | Experimental (kDa) | Theoretical (kDa) | Experimental (kDa) | Theoretical (kDa) |
| Fig. 1A | 213.3 | 212.5 | 163.9 | 162.0 | 82.7 | 81.0 | -- | -- |
| Fig. S1B | 245.3 | 240.4 | 144.7 | 139.6 | 139.6 | 137.4 | -- | -- |
| Fig. 1C | 248.3 | 246.7 | 194.7 | 196.3 | 195.7 | 196.3 | -- | -- |
| Fig. 1D | 493.1 | 493.4 | 384.8 | 392.6 | 191.6 | 196.3 | -- | -- |
| Fig. 1E | 458.8 | 460.2 | 356.2 | 359.4 | 196.6 | 196.5 | 78.6 | 81.5 |
| Fig. 1F | 395.3 | 392.2 | 296.1 | 291.4 | 203.3 | 196.5 | 47.3 | 47.5 |
| Fig. 1G | 321.3 | 331.6 | 225.3 | 230.8 | 127.5 | 135.4 | 47.2 | 47.7 |
| Fig. 1H | 328.6 | 331.6 | 234.9 | 230.8 | 138.9 | 135.6 | 48.9 | 47.6 |

Figure 84

| Structure | Molecule | $K_D$ | $K_D$ % Error | $K_D$ 95% CI | Valency | Activity | Activity % Error | Activity 95% CI |
|---|---|---|---|---|---|---|---|---|
| Fig. 1A | ACE2-615 homodimer | 1.56 nM | 2.1% | 922 pM ~ 2.60 nM | 2 | 140% | 2.1% | 116% ~ 177% |
| Fig. 1B | ACE2-740 heterodimer | 1.92 nM | 1.4% | 1.57 nM ~ 2.31 nM | 2 | 102% | 1.4% | 88.0% ~ 117% |
| Fig. 1C | ACE2-740 homodimer | 1.39 nM | 1.3% | 1.15 nM ~ 1.66 nM | 2 | 113% | 1.3% | 95.3% ~ 131% |
| Fig. 1D | ACE2-740 superhomodimer | 27.2 pM | 3.2% | 98.1 fM ~ 82.9 pM | 4 | 59.8% | 3.2% | 47.4% ~ 71.1% |
| Fig. 1E | ACE2-740/615 superheterodimer | 26.7 pM | 3.8% | 12.2 pM ~ 46.6 pM | 4 | 63.8% | 3.8% | 48.7% ~ 88.8% |
| Fig. 1F | ACE2-740/Fab superheterodimer | 15.8 pM | 1.6% | 11.5 pM ~ 20.8 pM | 4 | 38.5% | 1.6% | 33.3% ~ 44.1% |

Figure 85

| Structure | Molecule | SARS-CoV-2 | | NL63 | |
|---|---|---|---|---|---|
| | | IC50 (nM) | Relative Potency | IC50 (nM) | Relative Potency |
| Fig. 1A | ACE2-615 homodimer | 94.0 | 1 | 137 | 1 |
| Fig. 1C | ACE2-740 homodimer | 14.9 | 6 | 29.9 | 5 |
| Fig. 1D | ACE2-740 superhomodimer | 0.233 | 403 | 1.58 | 87 |
| Fig. 1A | ACE2-615 homodimer | 67.5 | 1 | >300 | 1 |
| Fig. 1C | ACE2-740 homodimer | 13.5 | 5 | 96.7 | 3 |
| Fig. 1E | ACE2-740/615 superheterodimer | 0.471 | 143 | 3.84 | 78 |
| Fig. 1B | ACE2-740 heterodimer | 84.0 | 1 | ND | ND |
| mAb | B13A antibody | 3.77 | 22 | ND | ND |
| Fig. 1F | ACE2-740/B13A superheterodimer | 0.130 | 646 | ND | ND |

Figure 86

| Structure | Molecule | SARS-CoV-2 | | |
|---|---|---|---|---|
| | | IC50 (nM) | Relative Potency | Relative Potency |
| Fig. 1C | ACE2-740 homodimer | 17.2 | 1 | |
| Fig. 1D | ACE2-740 superhomodimer | 1.93 | 8.9 | |
| Fig. 1E | ACE2-740/615 superheterodimer | 1.62 | 10.6 | |
| Fig. 1C | ACE2-740 homodimer | 17.2 | | 1 |
| mAb | B13 antibody | 5.91 | | 2.9 |
| Fig. 1F | ACE2-740/B13A superheterodimer | 1.54 | | 11.1 |

Figure 87

| Structure | Molecule | SARS-CoV-2 Variant | Fab Type | | | | | |
|---|---|---|---|---|---|---|---|---|
| | | | REGN10987 IC50 (nM) | REGN10933 IC50 (nM) | LY-CoV555 IC50 (nM) | LY-CoV016 IC50 (nM) | VIR-7831 IC50 (nM) | CT-P59 IC50 (nM) |
| mAb | Parent antibody | D614G | 0.051 | 0.035 | 0.029 | 0.168 | 0.318 | 0.002 |
| Fig. 1F | ACE2-740/Fab superheterodimer (ACE2 WT) | D614G | 0.017 | 0.017 | 0.026 | 0.036 | 0.165 | 0.006 |
| Fig. 1F | ACE2-740/Fab superheterodimer (ACE2 HA) | D614G | 0.016 | 0.016 | 0.022 | 0.029 | 0.249 | 0.005 |
| Fig 1G | Fab/Fab superheterodimer | D614G | 0.005 | 0.004 | 0.013 | 0.013 | 0.153 | 0.004 |
| mAb | Parent antibody | B.1.135 | 0.035 | >10 | >10 | >10 | 0.486 | 0.288 |
| Fig. 1F | ACE2-740/Fab superheterodimer (ACE2 WT) | B.1.135 | 0.011 | 0.030 | 2.104 | 0.371 | 0.108 | 0.011 |
| Fig. 1F | ACE2-740/Fab superheterodimer (ACE2 HA) | B.1.135 | 0.008 | 0.026 | 2.131 | 0.651 | 0.148 | 0.010 |
| Fig. 1G | Fab/Fab superheterodimer | B.1.135 | 0.003 | 0.103 | >10 | >10 | 0.129 | 0.003 |

Figure 88

| Structure | Protein ID | Spike-Binding Protein (SBP) | Molar Mass of SBP (kDa) | *Molar Mass of Spike-SBP Complex (kDa) | Molar Ratio SBP:Spike Trimer |
|---|---|---|---|---|---|
| Fig. 1A | | ACE2-615 homodimer | 214.2 | 782.4 | 0.91 |
| Fig. 1B | | ACE2-740 heterodimer | 292.1 | 854.6 | 0.91 |
| Fig. 1C | | ACE2-740 homodimer | 251.5 | 839.6 | 1.00 |
| Fig. 1D | | ACE2-740 superhomodimer | 501.3 | 1522.5 | 1.86 |
| Fig. 1E | HB1507 | ACE2-740/615 superheterodimer | 458.2 | 1082.7 | 1.08 |
| Fig. 1F | HB1516 | ACE2-740/B13A superheterodimer | 387.3 | 2314.2 | 4.46 |
| Fig. 1G | HB1401 | RG1-RG1 superheterodimer | 324.6 | 922.0 | 1.03 |
| Fig. 1G | HB1403 | RG2-RG2 superheterodimer | 329.4 | 962.1 | 1.14 |
| Fig. 1G | HB1405 | LY1-LY1 superheterodimer | 326.2 | 979.4 | 1.20 |
| Fig. 1G | HB1407 | LY-2-LY2 superheterodimer | 313.6 | 911.0 | 1.03 |
| Fig. 1G | HB1413 | VR1-VR1 superheterodimer | 325.3 | 1344.9 | 2.33 |
| Fig. 1G | HB1414 | CT1-CT1 superheterodimer | 317.0 | 1027.4 | 1.39 |
| Fig. 1G | HB1409 | AZ1-AZ1 superheterodimer | 325.8 | 911.7 | 0.99 |
| Fig. 1H | HB1701 | RG1-RG2 superheterodimer | 323.5 | 1819.5 | 3.81 |
| Fig. 1H | HB1722 | RG2-RG1 superheterodimer | 312.1 | 1305.7 | 2.30 |
| Fig. 1H | HB1410 | AZ1-AZ2 superheterodimer | 336.9 | 2647.4 | 6.11 |
| Fig. 1H | HB1412 | AZ2-AZ1 superheterodimer | 319.2 | 1790.9 | 3.77 |
| mAb | RG1 | REGN10987 | 146.4 | 968.5 | 2.60 |
| mAb | RG2 | REGN10933 | 147.2 | 1181.2 | 4.03 |
| mAb | LY1 | LY-CoV555 | 146.5 | 1176.6 | 4.02 |
| mAb | LY2 | LY-CoV016 | 148.4 | 900.2 | 2.11 |
| mAb | AZ1 | AZD1061 | 151.8 | 1054.3 | 3.07 |
| mAb | AZ2 | AZD8895 | 150.9 | 1033.6 | 2.95 |
| mAb | VR1 | VIR-7831 | 148.2 | 1170.5 | 3.93 |
| mAb | CT1 | CT-P59 | 151.2 | 1203.8 | 4.07 |
| mAb | B13A | HB1209 | 144.9 | 1024.4 | 3.01 |

*Each species was a well-formed symmetrical peak. Abbreviations: SBP, spike-binding protein

Figure 89

| Structure | Molecule | Mouse | C0 (ug/mL) | Cmax (ug/mL) | AUCall (day*ug/mL) | AUCINF (day*ug/mL) | CL (mL/day/kg) | T1/2 (day) | Rsq_adjusted |
|---|---|---|---|---|---|---|---|---|---|
| Fig. 1F | ACE2-740/B13A superheterodimer (ACE2 WT) | 1 | 518 | 511 | 1210 | 1430 | 6.97 | 10.9 | 0.973 |
| | ACE2-740/B13A superheterodimer (ACE2 WT) | 2 | 317 | 315 | 1250 | 1460 | 6.85 | 10.3 | 0.956 |
| | | **Mean** | **418** | **413** | **1230** | **1450** | **6.91** | **10.6** | **0.965** |
| Fig. 1F | ACE2-740/B13A superheterodimer (ACE2 HA) | 1 | 224 | 222 | 514 | 569 | 17.6 | 9.74 | 0.935 |
| | ACE2-740/B13A superheterodimer (ACE2 HA) | 2 | 205 | 204 | 700 | 834 | 12 | 13.1 | 0.94 |
| | ACE2-740/B13A superheterodimer (ACE2 HA) | 3 | 240 | 238 | 603 | 678 | 14.8 | 10.7 | 0.953 |
| | | **Mean** | **223** | **221** | **606** | **694** | **14.8** | **11.2** | **0.943** |
| Fig. 1G | RG2-RG2 superheterodimer | 1 | 158 | 157 | 853 | 1070 | 9.3 | 13.1 | 0.791 |
| | RG2-RG2 superheterodimer | 2 | 176 | 175 | 853 | 1220 | 8.19 | 17.6 | 0.686 |
| | RG2-RG2 superheterodimer | 3 | 144 | 143 | 782 | 1240 | 8.08 | 22 | 0.889 |
| | | **Mean** | **159** | **158** | **829** | **1180** | **8.52** | **17.6** | **0.789** |
| mAb | REGN10933 (RG2) | 1 | 226 | 224 | 903 | 1120 | 8.9 | 12.9 | 0.991 |
| | REGN10933 (RG2) | 2 | 204 | 202 | 853 | 986 | 10.4 | 9.84 | 0.954 |
| | REGN10933 (RG2) | 3 | 176 | 175 | 882 | 1220 | 8.21 | 16.1 | 0.956 |
| | | **Mean** | **202** | **200** | **879** | **1100** | **9.15** | **12.9** | **0.967** |
| Fig. 1G | VR1-VR1 superheterodimer | 1 | 149 | 147 | 568 | 821 | 12.2 | 16.7 | 0.982 |
| | VR1-VR1 superheterodimer | 2 | 120 | 118 | 474 | 659 | 15.2 | 16 | 0.965 |
| | | **Mean** | **134** | **133** | **521** | **740** | **13.7** | **16.3** | **0.973** |
| mAb | VIR-7831 (VR1) | 1 | 160 | 158 | 643 | 769 | 13 | 10.6 | 0.96 |
| | VIR-7831 (VR1) | 2 | 127 | 126 | 591 | 797 | 12.5 | 15.1 | 0.965 |
| | VIR-7831 (VR1) | 3 | 150 | 148 | 543 | 803 | 12.5 | 18.4 | 0.842 |
| | | **Mean** | **146** | **144** | **592** | **790** | **12.7** | **14.7** | **0.922** |

Figure 90

| Molecule | Specific Activity (pmol/min/μg) | | |
|---|---|---|---|
| | Angiotensin II | Bradykinin | Apelin-13 |
| ACE2-740/B13A superheterodimer (ACE2 WT) | 1,655.20 | 1,724.80 | 688.00 |
| ACE2-740/B13A superheterodimer (ACE2 HA) | 0.76 | 1.14 | 1.01 |
| Recombinant human ACE2 | 1,874.40 | 2,032.40 | 764.40 |

Figure 91

| Molecule | Variant IC50 (nM) | | | | | | | | | | | | | | | |
|---|---|---|---|---|---|---|---|---|---|---|---|---|---|---|---|---|
| | D614G B.1 | N439K | Alpha B.1.1.7 | Alpha B.1.1.7 E484K | Beta B.1.351 | Gamma P.1 | Delta B.1.617.2 | Epsilon B.1.427/ B.1.429 | Zeta P.2 | Eta B.1.525 | Iota B.1.526 | Kappa B.1.617.1 | Lambda C.37 | Mu B.1.621 | Omicron B.1.1.529 | SARS-CoV-1 Urbani |
| HB1507 | 0.242 | 0.025 | 0.081 | 0.049 | 0.059 | 0.041 | 0.100 | 0.118 | 0.101 | 0.085 | 0.162 | 0.132 | 0.102 | 0.060 | 0.016 | 1.138 |
| HB1553 | 0.330 | 0.029 | 0.099 | 0.062 | 0.090 | 0.039 | 0.123 | 0.155 | 0.116 | 0.115 | 0.303 | 0.155 | 0.102 | 0.069 | 0.007 | 0.810 |
| HB1515 | 0.038 | 0.108 | 0.033 | 0.024 | 0.027 | 0.023 | 0.015 | 0.017 | 0.021 | 0.017 | 0.026 | 0.012 | 0.047 | 0.012 | 1.218 | 0.141 |
| HB1516 | 0.046 | 0.126 | 0.032 | 0.013 | 0.023 | 0.031 | 0.015 | 0.013 | 0.028 | 0.030 | 0.027 | 0.017 | 0.043 | 0.018 | 0.990 | 0.123 |
| REGN10987 | 0.030 | 1.285 | 0.016 | 0.012 | 0.032 | 0.012 | 0.058 | 0.033 | 0.033 | 0.045 | 0.075 | 0.048 | 0.190 | 0.025 | >10 | >10 |
| REGN10933 | 0.045 | 0.027 | 0.023 | 0.748 | 2.374 | 2.538 | 0.011 | 0.022 | 0.469 | 0.446 | 0.895 | 0.385 | 0.020 | 0.637 | >10 | >10 |
| LY-CoV555 | 0.042 | 0.039 | 0.034 | >10 | >10 | >10 | >10 | >10 | >10 | >10 | >10 | >10 | >10 | >10 | >10 | >10 |
| LY-CoV016 | 0.271 | 0.176 | 2.471 | >10 | >10 | >10 | 0.056 | 0.217 | 0.352 | 0.336 | 0.875 | 0.162 | 0.054 | 3.148 | >10 | >10 |
| AZD1061 | 0.050 | 0.060 | 0.038 | 0.039 | 0.048 | 0.033 | 0.119 | 0.082 | 0.045 | 0.029 | 0.050 | 0.186 | 0.182 | 0.184 | >10 | >10 |
| AZD8895 | 0.033 | 0.019 | 0.042 | 0.786 | 0.240 | 0.078 | 0.020 | 0.021 | 0.212 | 0.282 | 0.384 | 0.039 | 0.007 | 0.229 | >10 | >10 |
| VIR-7831 | 0.461 | 0.396 | 0.619 | 0.281 | 0.354 | 0.371 | 0.552 | 0.351 | 0.471 | 0.635 | 0.232 | 0.440 | 0.943 | 0.514 | 2.171 | 0.468 |
| CT-P59 | 0.007 | 0.008 | 0.019 | 0.574 | 1.085 | 0.593 | 0.258 | 0.223 | 0.029 | 0.015 | 0.044 | 0.137 | 0.106 | 0.284 | >10 | >10 |
| B13A | 0.088 | 0.056 | 0.076 | 0.035 | 0.202 | 0.070 | 0.031 | 0.012 | 0.129 | 0.216 | 0.109 | 0.033 | 0.272 | 0.011 | >10 | 0.110 |

Figure 92

| Structure | Protein ID | Molecule | N439K | | B.1.351 | | N439K/B.1.351 | |
|---|---|---|---|---|---|---|---|---|
| | | | IC50 (nM) | Relative Potency | IC50 (nM) | Relative Potency | IC50 (nM) | Relative Potency |
| Fig. 1H | HB1701 | RG1-RG2 superheterodimer | 0.011 | 1.5 | 0.008 | 2.7 | 0.051 | 25.3 |
| | HB1705 | RG2-RG1 superheterodimer | 0.021 | 0.8 | 0.030 | 0.7 | 0.074 | 17.5 |
| | HB1713 | RG1-RG2 superheterodimer | N.D. | N.D. | N.D. | N.D. | 0.057 | 22.6 |
| | HB1722 | RG2-RG1 superheterodimer | 0.008 | 2.0 | 0.009 | 2.2 | 0.080 | 16.2 |
| mAb | REGN10987 | REGN10987 | 4.437 | 0.0 | 0.021 | 1.0 | 3.111 | 0.4 |
| | REGN10933 | REGN10933 | 0.019 | 0.9 | 6.740 | 0.0 | 9.322 | 0.1 |
| | REGN-COV2 | REGN10987+REGN10933 | 0.016 | 1.0 | 0.020 | 1.0 | 1.297 | 1.0 |
| Fig. 1E | HB1507 | ACE2-740/615 superheterodimer | 0.108 | 0.2 | 0.059 | 0.3 | 0.034 | 38.5 |
| | HB1553 | ACE2-740/615 superheterodimer | 0.126 | 0.1 | 0.090 | 0.2 | 0.023 | 57.0 |
| Fig. 1F | HB1515 | ACE2-740/B13A superheterodimer | 0.029 | 0.6 | 0.027 | 0.8 | 0.029 | 45.2 |
| | HB1516 | ACE2-740/B13A superheterodimer | 0.025 | 0.6 | 0.023 | 0.9 | 0.025 | 52.8 |

Figure 93

| Structure | Protein ID | Specificity | Plate 1 | | Plate 2 | |
|---|---|---|---|---|---|---|
| | | | EC50 (pM) | Relative Potency | EC50 (pM) | Relative Potency |
| mAb | Rituxan | anti-CD20 | 177 | 1.0 | 135.5 | 1.0 |
| mAb | FMC63 | anti-CD19 | 5.0 | 35.4 | 5.0 | 27.1 |
| mAb + mAb | Rituxan + FMC63 | anti-CD20 + anti-CD19 | ND | ND | 78.5 | 1.7 |
| Fig. 1H | HB1905 | Bispecific anti-CD20/anti-CD19 | 2.0 | 88.4 | ND | ND |
| Fig. 1H | HB1906 | Bispecific anti-CD20/anti-CD19 | 1.8 | 98.2 | ND | ND |

Figure 94

| Structure | Configuration | Protein ID | Specificity | WEHI-164 TNF-α Cytotoxicity Assay | | IL-17A Reporter Assay | |
|---|---|---|---|---|---|---|---|
| | | | | IC50 (nM) | Relative Potency | IC50 (nM) | Relative Potency |
| mAb | Ad | Adalimumab | anti-TNF-α | 0.061 | 1.0 | > 600 | N/A |
| mAb | Se | Secukinumab | anti-IL-17A | > 60 | N/A | 15.03 | 1.0 |
| Fig. 1H | Ad x Se | HB2309 | Bispecific anti-TNF-α/anti-IL-17A | 0.087 | 0.7 | 1.26 | 12.0 |
| Fig. 1H | Ad x Se | HB2310 | Bispecific anti-TNF-α/anti-IL-17A | 0.091 | 0.7 | 1.66 | 9.1 |
| Fig. 1H | Se x Ad | HB2313 | Bispecific anti-TNF-α/anti-IL-17A | 0.059 | 1.0 | 13.81 | 1.1 |
| Fig. 1H | Se x Ad | HB2314 | Bispecific anti-TNF-α/anti-IL-17A | 0.059 | 1.0 | 14.45 | 1.0 |

Figure 95

NK/MONOCYTE ENGAGERS

This application is a continuation of U.S. patent application Ser. No. 18/949,940, filed Nov. 15, 2024, which is continuation-in-part of U.S. patent application Ser. No. 18/188,412, filed Mar. 22, 2023, which (a) is a continuation-in-part of U.S. patent application Ser. No. 18/153,840, filed Jan. 12, 2023, which claims benefit of U.S. Provisional Application No. 63/298,999, filed Jan. 12, 2022, and (b) claims benefit of (i) U.S. Provisional Application No. 63/322,594 filed Mar. 22, 2022, and (ii) U.S. Provisional Application No. 63/434,866, filed Dec. 22, 2022, the contents of each of which are hereby incorporated by reference.

Throughout this application, various publications are referenced, including referenced in parenthesis. The disclosures of all publications mentioned in this application in their entireties are hereby incorporated by reference into this application in order to provide additional description of the art to which this invention pertains and of the features in the art which can be employed with this invention.

REFERENCE TO SEQUENCE LISTING

This application incorporates-by-reference nucleotide sequences which are present in the file named "250211_91300-HA_SequenceListing_DH.xml", which is 11,559,292 bytes in size, and which was created on Feb. 10, 2025 in the IBM-PC machine format, having an operating system compatibility with MS-Windows, which is contained in the xml file filed Feb. 10, 2025 as part of this application.

BACKGROUND OF THE INVENTION

Antibodies are a diverse family of vertebrate proteins comprising a Y-shaped structure consisting of two antigen binding (Fab) domains and one effector cell binding (Fc) domain. The arrangement of these three domains around a central hinge region bears a striking resemblance to trigonal molecular geometries in which a central atom is bonded to three peripheral atoms arranged at the corners of a triangle. Such a planar configuration of binding domains is sufficient for antibodies to carry out their normal functions. As such, efforts to-date to engineer antibodies and antibody-like molecules have also generally adopted the natural planar configuration of antibody binding domains. However, when the binding domains of an engineered antibody and antibody-like molecule are intended to engage multiple targets, a planar configuration of binding domains is not ideally suited to permit the simultaneous engaging of multiple targets by the binding domains.

SUMMARY OF THE INVENTION

This invention provides a tetrahedral antibody comprising a first domain, a second domain, a third domain, a fourth, a fifth domain, and a sixth domain which is formed by a first H1 polypeptide chain, a second H1 polypeptide chain, a first H2 polypeptide chain, and a second H2 polypeptide chain, a first L1 polypeptide chain, a second L1 polypeptide chain, a first L2 polypeptide chain, and a second L2 polypeptide chain, wherein:

a) the first domain and the second domain are each a Fc domain of an IgG antibody;
b) the third domain and the fourth domain are each a Fab domain of an anti-CD20 antibody;
c) the fifth domain and the sixth domain are each a Fab domain of an anti-CD-19 antibody;

d) the first and second H1 polypeptide chains comprise the amino acid sequence set forth in SEQ ID NO: 4775, the first and second H2 polypeptide chains comprise the amino acid sequence set forth in SEQ ID NO: 4730, the first and second L1 polypeptide chains comprise the amino acid sequence set forth in SEQ ID NO: 4819, and the first and second L2 polypeptide chains comprise the amino acid sequence set forth in SEQ ID NO: 4810;
e) the C-terminal portion of the first H1 polypeptide chain and the C-terminal portion of the first H2 polypeptide chain pair with one another to form the first domain;
f) the C-terminal portion of the second H1 polypeptide chain and the C-terminal portion of the second H2 polypeptide chain pair with one another to form the second domain;
g) the N-terminal portion of the first H1 polypeptide chain pairs with the first L1 polypeptide chain to form the third domain;
h) the N-terminal portion of the second H1 polypeptide chain pairs with the second L1 polypeptide chain to form the fourth domain;
i) the N-terminal portion of the first H2 polypeptide chain pairs with the first L2 polypeptide chain to form the fifth domain;
j) the N-terminal portion of the second H2 polypeptide chain pairs with the second L2 polypeptide chain to form the sixth domain; and
k) the first H1 polypeptide chain dimerizes with the second H1 polypeptide chain at an ACE2 collectrin-like domain dimerizing polypeptide which is within each H1 chain between the C-terminal portion that pairs with the H2 polypeptide chain and the N-terminal portion that pairs with the L1 polypeptide chain.

BRIEF DESCRIPTION OF THE DRAWINGS

FIG. 46: Pharmacokinetic curves for constructs 10-05 and 13-21. 10-05 corresponds to the ACE2-ACE2 superheterodimer tetrahedral antibody. 13-21 corresponds to wt ACE2-B13 superheterodimer tetrahedral antibody.

HB1722 RG2-RG1 superheterodimer, (Panels D to F) ACE2-740/615 superheterodimer (HB1507, HB1553), and (Panels G to I) ACE2-740/B13A superheterodimers (HB1515, HB1516) compared with the REGN10987 (RG1) and REGN10933 (RG2) antibodies used as single agents or as a two-antibody cocktail (REGN-COV2) against the (Panels A, D, and G) N439K variant, (Panels B, E, and H) B.1.351 variant, and (Panels C, F, and I) N439K/B.1.351 variant. HB1722 (squares), REGN10987 (circles), REGN10933 (triangles), REGN-COV2 (inverted triangles), HB1507 (squares), HB1515 (diamonds), HB1515 (squares), HB1516 (diamonds).

Figure 80:
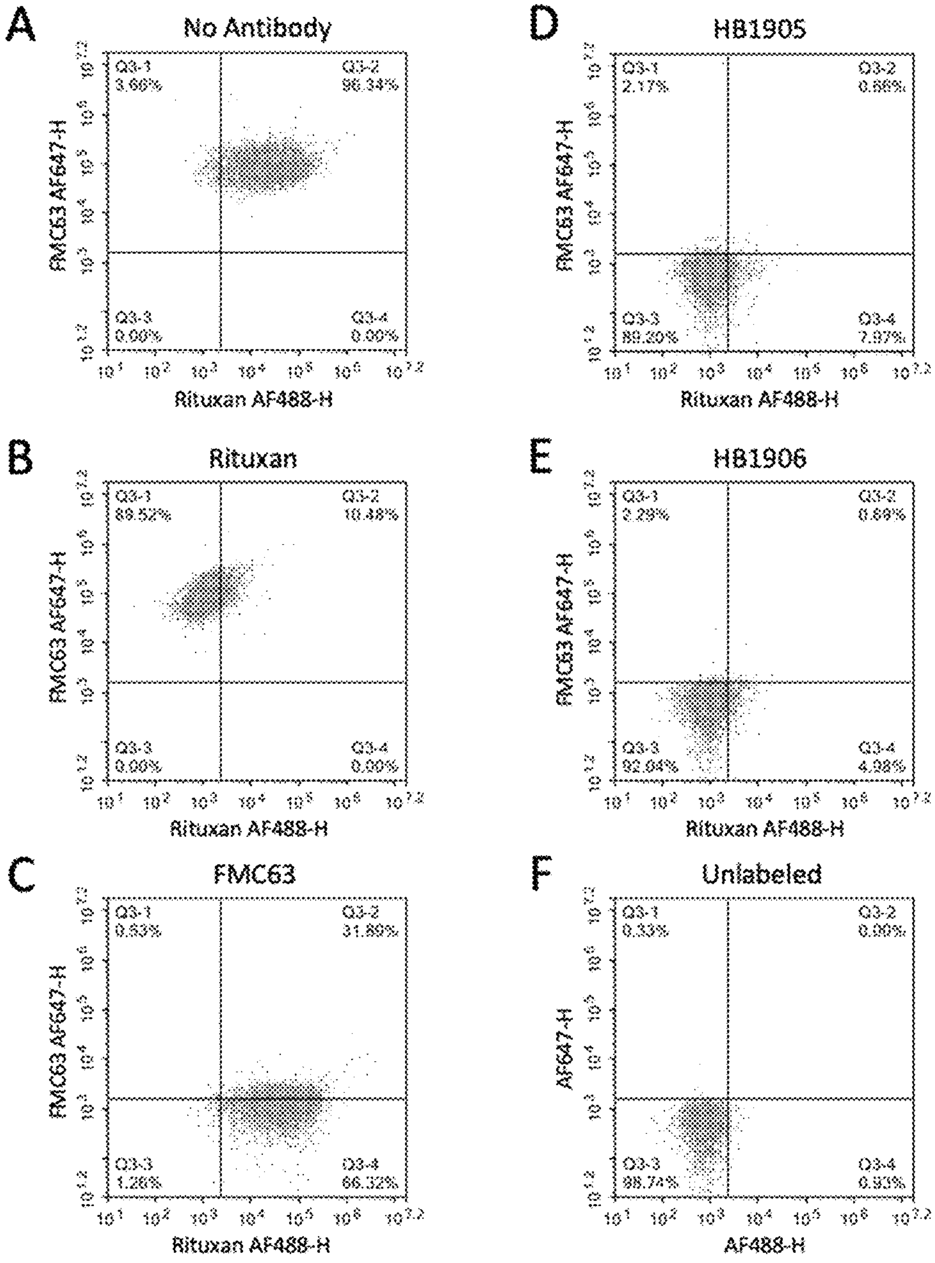

FIG. 80: Competition binding analysis of anti-CD20/anti-CD19 bispecific GEM-DIMERs (Fab1/Fab2 superheterodimers) for binding of cell surface CD20 and CD19 compared against their parent antibodies (Rituxan, FMC63). Flow cytometry analysis of CD20/CD19-positive Toledo cells labelled by incubation with AF488-labeled Rituxan and AF647-labeled FMC63 following pre-incubation of cells with (A) no antibody, (B) unlabeled Rituxan, (C) unlabeled FMC63, (D) GEM-DIMER HB1905, or (E) GEM-DIMER HB1906. (F) unlabeled Toledo cells.

Figure 81:
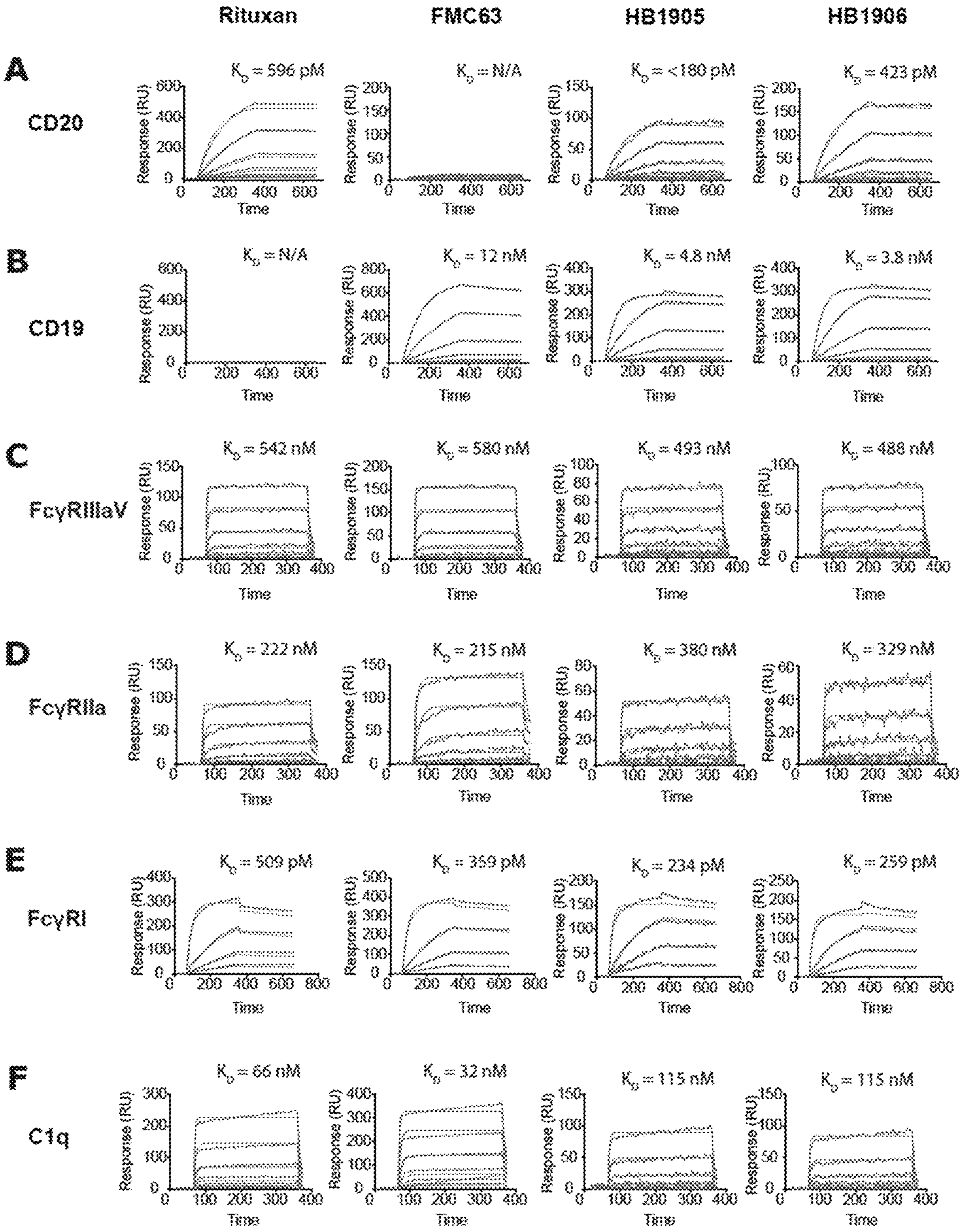

FIG. 81: Surface plasmon resonance (SPR) binding analysis of anti-CD20/anti-CD19 bispecific GEM-DIMERs (Fab1/Fab2 superheterodimers) to CD20, CD19, Fc gamma receptors, and complement C1q. SPR binding by HB1905 and HB1906 anti-CD20/CD19 bispecific superheterodimers (FIG. 52, Panel H) and Rituxan and FMC63 parent antibodies is shown for the following monovalent molecular targets: (A) CD20, (B) CD19, (C), Fc gamma RIIIa (CD16a) (Val176), (D) Fc gamma RIIa (CD32) (Arg167), (E) Fc gamma RI (CD64), and (F) complement component C1q.

FIG. 82: Neutralizing activity of anti-TNF-α/anti-IL-17A bispecific GEMDIMERS (Fab1/Fab2 superheterodimers) compared against their parent antibodies adalimumab and secukinumab. Panel A depicts neutralization of TNF-α induced cytotoxicity in WEHI-164 cells by GEM-DIMERs HB2309 and HB2310 (Ad x Se configuration), and HB2313 and HB2314 (Se x Ad configuration) compared with the adalimumab and secukinumab parent antibodies, and panel B depicts neutralization of IL-17A activity in an IL-17A reporter assay by HB2309 and HB2310 (Ad x Se) and HB2313 and HB2314 (Se x Ad) compared with the adalimumab and secukinumab parent antibodies.

Figure 83:
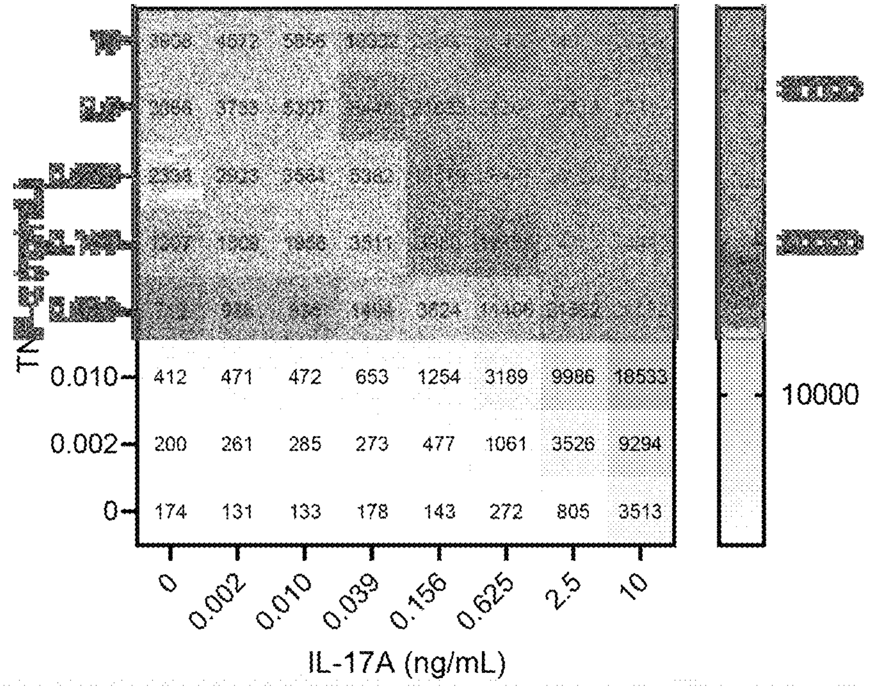

FIG. 83. Synergistic induction of IL-6 by TNF-α and IL-17A in normal human dermal fibroblasts (NHDF). Induction of IL-6 is shown for increasing amounts of human TNF-α and IL-17A alone or in combination. IL-6 was measured following a 24-hour cytokine incubation period.

Figure 57:
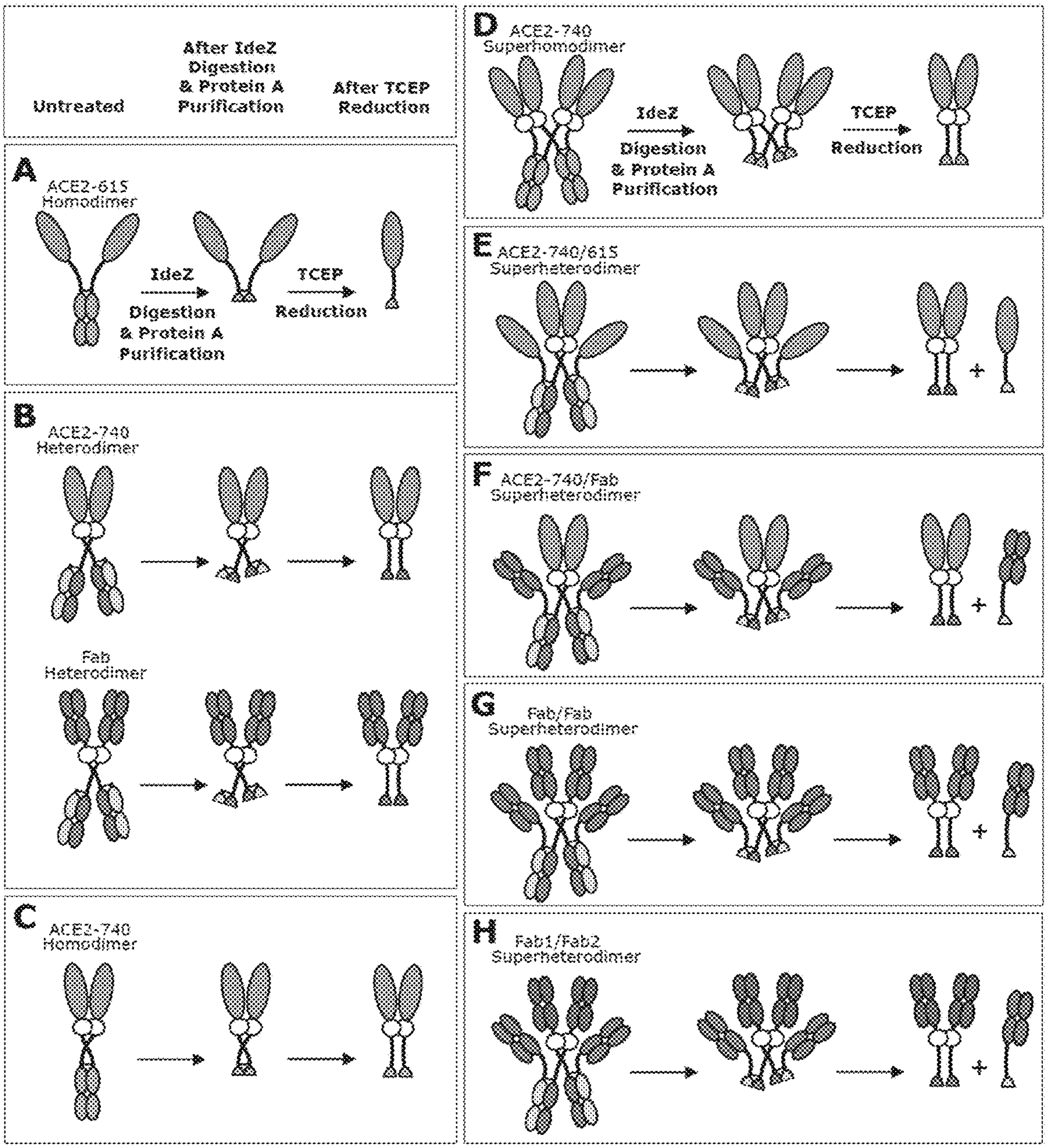
FIG. 57: Strategy for the confirmation of the structures of the topologically distinct molecules described in Example 32 using specific cleavage with IdeZ and TCEP reduction. Molecules were digested with IdeZ protease followed by incubation with protein A beads to remove Fc fragments and incompletely digested molecules. The untreated, IdeZ-treated, and IdeZ-treated/TCEP-reduced molecules were analyzed by SEC/MALS (FIG. 58, FIG. 84). Predicted fragments are depicted for (A) ACE2-615 homodimer (Panel A of FIG. 52), (B) ACE2-740 heterodimer (Panel B of FIG. 52) and its Fab-substituted counterpart, (C) ACE2-740 homodimer (Panel C of FIG. 52), (D) ACE2-740 superhomodimer (Panel D of FIG. 52), (E) ACE2-740/615 superheterodimer (Panel E of FIG. 52), (F) ACE2-740/B13A superheterodimer (Panel F of FIG. 52), (G) Fab/Fab superheterodimer (Panel G of FIG. 52), and (H) Fab1/Fab2 superheterodimer (Panel H of FIG. 52).
Figure 58:
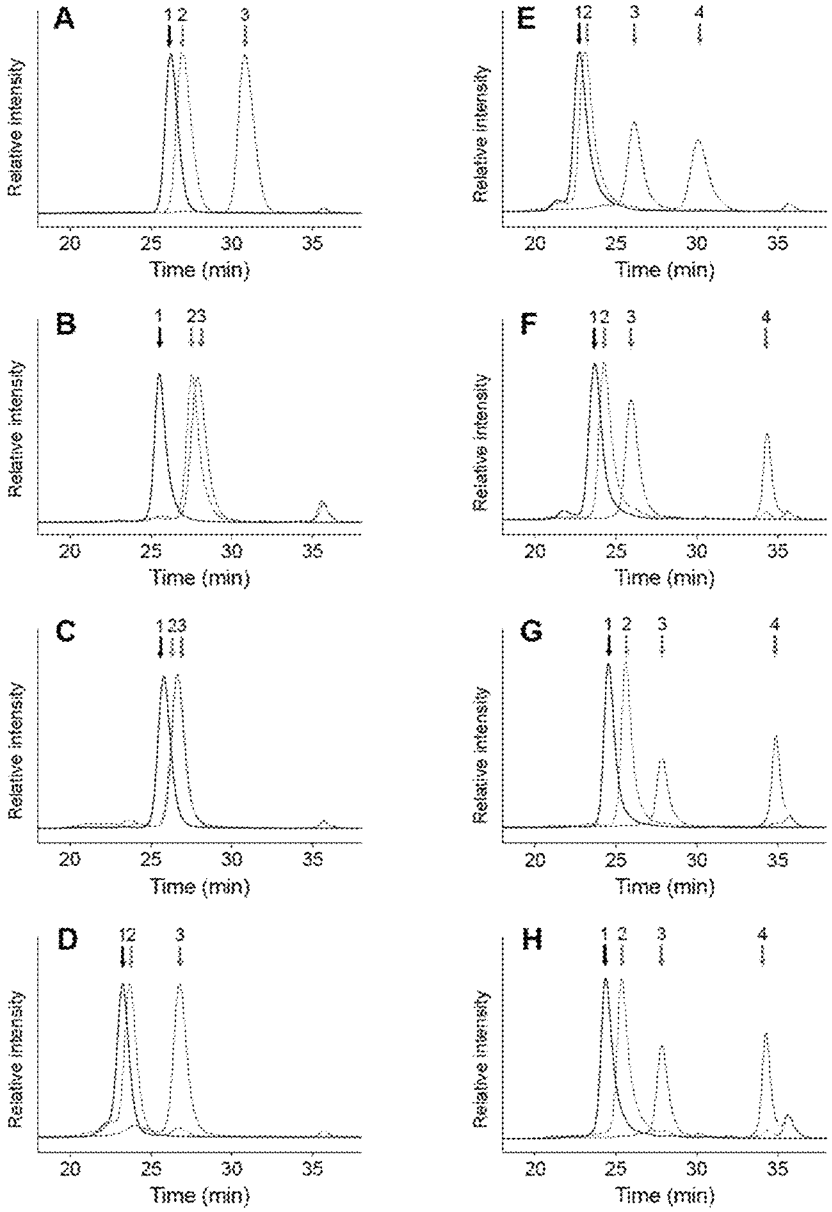
FIG. 58. SE-HPLC analysis of the topologically distinct molecules described in Example 32 following IdeZ cleavage and TCEP reduction. SE-HPLC elution profiles of untreated, IdeZ-treated, and IdeZ-treated/TCEP-reduced molecules are shown by curves 1, 2, 3 and 4 as follows: Arrow 1 points to the intact molecule, arrow 2 points to the IdeZ cleavage product, and arrows 3 and 4 point to the TCEP-reduced IdeZ cleavage product(s). As expected, IdeZ cleavage products that are dimerized solely by the Fc domain were dissociated upon TCEP reduction of the hinge region interchain disulfides, while IdeZ cleavage products dimerized by the collectrin-like domain did not dissociate upon TCEP reduction. To further confirm each structure, the molar mass of each of the observed peaks was determined by SEC-MALS as described in table S1. The following molecules were analyzed: (A) ACE2-615 homodimer (Panel A of FIG. 52), (B) Fab heterodimer (Panel B of FIG. 57), (C) ACE2-740 homodimer (Panel C of FIG. 52), (D) ACE2-740 superhomodimer (Panel D of FIG. 52), (E) ACE2-740/615 superheterodimer (Panel E of FIG. 52), (F) ACE2-740/B13A superheterodimer (Panel F of FIG. 52), (G) Fab/Fab superheterodimer (Panel G of FIG. 52), and (H) Fab1/Fab2 superheterodimer (Panel H of FIG. 52).
Figure 59:
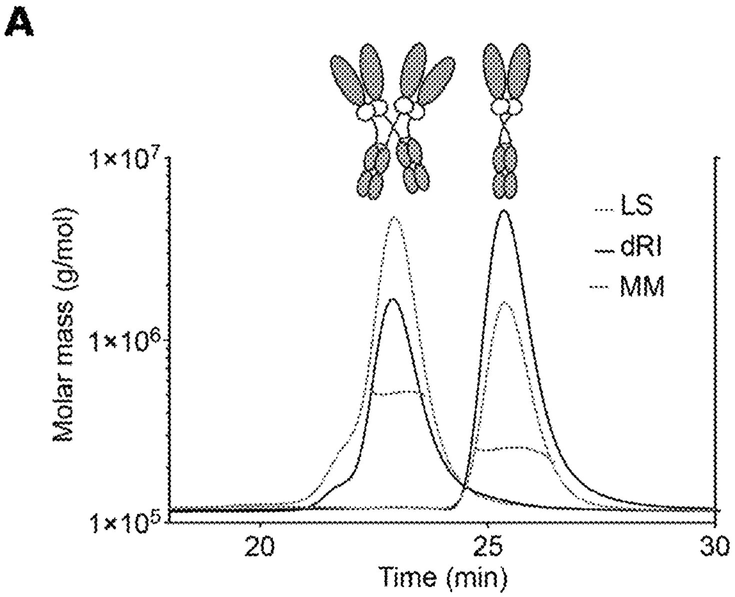
FIG. 59: SEC-MALS demonstrates that the molar mass of ACE2-740 superhomodimer is approximately twice that of ACE2-740 homodimer. Purified preparations of ACE2-740 superhomodimer (Panel D of FIG. 52) and ACE2-740 homodimer (Panel C of FIG. 52) were analyzed individually by SEC-MALS. The profiles are overlaid for comparison. Molar masses are summarized in FIG. 84. Abbreviations: LS, light scattering; dRI, differential refractive index; MM, molar mass.

FIG. 84: Molar masses determined for the topologically distinct molecules described in Example 32 and their IdeZ cleavage products confirms their structures. The molar mass of each of the observed peaks in FIG. 58 was determined by SEC-MALS. The theoretical molar mass of each of the observed peaks in FIG. 58 was calculated using the known amino acid sequence of each of the predicted structures depicted in FIG. 57, together with the known N-glycan and O-glycan modifications of each of the predicted structures (ref. 26).

FIG. 85: Quantitative solution binding analysis of spike trimer binding to ACE superdimers and dimers. $K_D$ values were determined by kinetic exclusion analysis (KinExA) n-curve analysis. Binding reactions were carried out in solution using SARS-CoV-2 spike trimer as the titrant and each of the following ACE2 superdimer or dimer molecules as the constant binding partner: ACE-615 homodimer, ACE2-740 heterodimer, ACE2-740 homodimer, ACE2-740 superhomodimer, ACE2-740/615 superheterodimer, ACE2-740/B13A superheterodimer. Valency refers to the number of monovalent spike protein sites (i.e., ACE peptidase domains). \

FIG. 86: Live virus neutralizing activity of ACE2 superdimers and dimers against SARS-CoV-2 and NL63. Neutralization activity ($IC_{50}$) against SARS-CoV-2 and NL63 is shown for the following molecules: (Panel D of FIG. 53) ACE-615 homodimer, ACE2-740 homodimer, ACE2-740 superhomodimer; (Panel E of FIG. 53) ACE-615 homodimer, ACE2-740 homodimer, ACE2-740/615 superhomodimer; (Panel F of FIG. 53) ACE-615 heterodimer, B13A antibody, ACE2-740/B13A superheterodimer.

FIG. 87: Neutralization of SARS-CoV-2 spike trimer binding to cell surface ACE2 receptors. Neutralization activity ($IC_{50}$) against binding of aggregate-free spike trimer to ACE2 receptors expressed on the surface of 293 embryonic kidney cells is shown for the following molecules: (Panel G of FIG. 54) ACE-740 homodimer, ACE2-740 superhomodimer, ACE2-740/615 superheterodimer; (Panel H of FIG. 54) ACE-740 homodimer, B13A antibody, ACE2-740/B13A superheterodimer.

FIG. 88: Pseudovirus neutralizing activity of ACE2-740/Fab superheterodimers and antibody Fab/Fab superheterodimers compared with their parent antibodies. Neutralization activity ($IC_{50}$) against Wuhan D614G and B.1.351 variants by ACE2-740/Fab superheterodimers, Fab/Fab superheterodimers, and their parent antibodies. Parent antibodies: RG1 (REGN10987), RG2 (REGN10933), LY1 (LY-CoV555), LY2 (LY-CoV016), VR1 (VIR-7831), and CT1 (CT-P59); ACE2-740/Fab superheterodimers (ACE2 WT): RG1-ACE2 WT, RG2-ACE2 WT, LY1-ACE2 WT, LY2-ACE2 WT, VR1-ACE2 WT, CT1-ACE2 WT; ACE2-740/Fab superheterodimers (ACE2 HA): RG1-ACE2 HA, RG2-ACE2 HA, LY1-ACE2 HA, LY2-ACE2 HA, VR1-ACE2 HA, CT1-ACE2 HA; Fab/Fab superheterodimers: RG1-RG1, RG2-RG2, LY1-LY1, LY2-LY2, VR1-VR1, CT1-CT1. Abbreviations: ACE2 WT, ACE2 with wild-type angiotensin-converting activity; ACE2 HA, ACE2 with the H378A mutation which abrogates angiotensin-converting activity.

FIG. 89: Stoichiometry of spike trimer binding the topologically distinct molecules described in Example 32. SEC-MALS was used to determine the molar mass of each spike-binding protein and the molar mass of each binding complex that formed when an excess of each spike-binding protein was incubated with aggregate-free, individual spike trimers (Mr=587.7 kDa). The following equation was used to determine the molar ratio of spike binding protein to individual spike trimer for each complex:

$$\frac{\text{Spike Binding Protein}}{\text{Spike Trimer}} = \frac{\text{Molar Mass of Complex} - \text{Molar Mass of Spike Trimer}}{\text{Molar Mass of Spike Binding Protein}}$$

FIG. 90: Pharmacokinetic parameters for ACE2-740/B13A superheterodimers, antibody Fab/Fab superheterodimers, and parent antibodies in Tg32 mice. Pharmacokinetic parameters for ACE2-740/B13A superheterodimer (ACE2 WT), ACE2-740/B13A superheterodimer (ACE2 HA), RG2-RG2 superheterodimer, RG2 (REGN10933) (parent antibody), VR1-VR1 superheterodimer, VR1 (VIR-7831). Abbreviations: ACE2 WT, ACE2 with wild-type angiotensin-converting activity; ACE2 HA, ACE2 with the H378A mutation which abrogates angiotensin-converting activity. Abbreviations: C0, concentration at time=0 calculated by back-extrapolation through the first two time points; Cmax, maximum observed plasma concentration; AUCall, area under the plasma concentration vs. time curve from time=0 through the last measurable time point; AUCinf, AUC extrapolated to infinity using the terminal slope calculated from the last 3 or more time points; CL, plasma clearance calculated from the Dose/AUCinf; T½, terminal half-life calculated from the terminal slope; Rsq adjusted, correlation associated with the estimation of the terminal slope, adjusted for sample size.

FIG. 91: Specific activity of ACE2-740/B13A superheterodimers with wild-type and H378A mutant peptidase domains. Specific activity of ACE2-740/B13A superheterodimer (ACE2 WT), ACE2-740/B13A superheterodimer (ACE2 HA), and recombinant human ACE2 as measured by phenylalanine release with the following substrates: (A) angiotensin II, (B) bradykinin, and (C) apelin-13. Abbreviations: ACE2 WT, ACE2 with wild-type angiotensin-converting activity; ACE2 HA, ACE2 with the H378A mutation which abrogates angiotensin-converting activity.

FIG. 92: Pseudovirus neutralizing activity of ACE2-740/615 superheterodimers (HB1507, HB1553) and ACE2-740/B13A superheterodimers (HB1515, HB1516) compared with eight clinically authorized antibodies. Neutralization activity ($IC_{50}$) of HB1507 and HB1553 (Panel F of FIG. 52), and HB1515 and HB1516 (Panel G of FIG. 52), compared with eight clinically authorized antibodies (REGN10987, REGN10933, LY-CoV555, LY-CoV016, AZD1061, AZD8895, VIR-7831, CT-P59) and the preclinical antibody B13A. Results for twelve major SARS-CoV-2 variants are shown: Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529. Results are also shown for SARS-CoV-2 variants Wuhan D614G, N439K, and Alpha B.1.1.7 E484K, and the SARS-CoV-1 Urbani variant. The HB1515, HB1516, HB1507, and HB1553 ACE2-740/B13A superheterodimers have the ACE2 H378A mutation which abrogates angiotensin-converting activity. HB1515 and HB1553 have wild-type Fc receptor binding activity; HB1516 and HB1507 have the L234A, L235A mutations which abrogate Fc receptor binding activity.

FIG. 93: Pseudovirus neutralizing activity of bispecific GEN-DIMERs (Fab1/Fab2 superheterodimers) compared with two-antibody cocktails of their parent antibodies. Pseudovirus neutralization activity ($IC_{50}$) against the N439K, B.1.351, and N439K/B.1.351 variants is shown for: bispecific RG1-RG2 superheterodimers (HB1701, HB1722) and RG2-RG1 superheterodimers (HB1705, HB1722), and the REGN10987 (RG1) and REGN10933 (RG2) parent antibodies used as single agents or as a two-antibody cocktail (REGN-COV2). Neutralization activity is also shown for ACE2-740/615 superheterodimers (HB1507, HB1553), and ACE2-740/B13A superheterodimers (HB1515, HB1516).

FIG. 94: ADCC activity of anti-CD20/anti-CD19 bispecific GEM DIMERs (Fab1/Fab2 superheterodimers) HB1905 and HB1906 compared with their parent antibodies. ADCC activity ($EC_{50}$) against CD20/CD19-positive Toledo cells is shown for HB1905 and HB1906 and their parent antibodies Rituxan (anti-CD20) and FMC63 (anti-CD19) used as single agents or as a two-antibody cocktail.

FIG. 95: Neutralizing activity of anti-TNF-α/anti-IL-17A bispecific GEMDIMERs (Fab1/Fab2 superheterodimers) compared against their parent antibodies adalimumab and secukinumab. Neutralizing activity against TNF-α and IL-17A is shown for bispecific GEM-DIMERs HB2309 and HB2310 (Ad x Se configuration), and HB2313 and HB2314 Se x Ad configuration) compared against their parent antibodies. Neutralization activity ($IC_{50}$) was determined for TNF-α-induced cytotoxicity in WEHI-164 cells, and for IL-17A activity in an IL-17A reporter assay.

Figure 96:
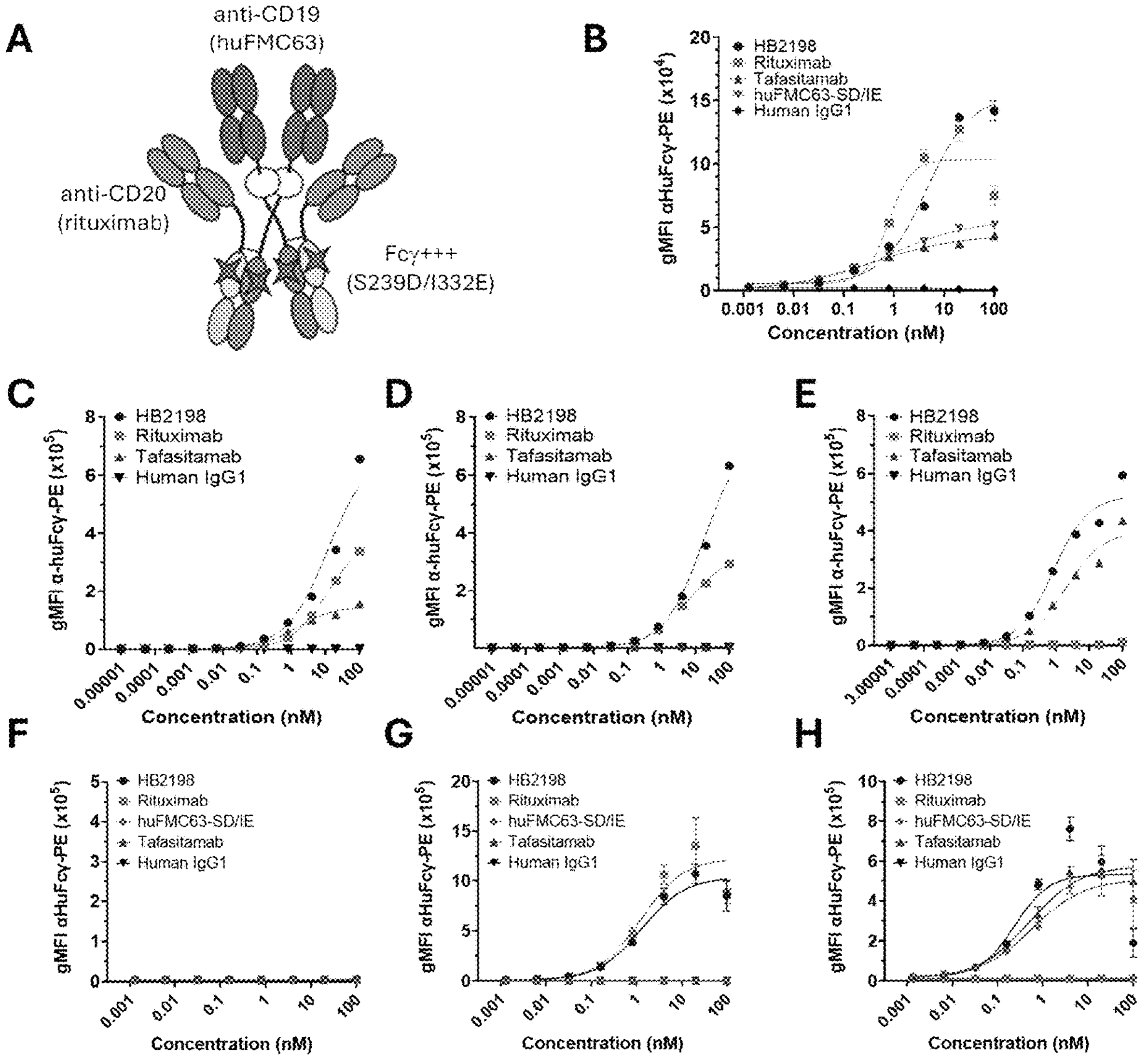

FIG. 96: Structure and target binding of HB2198 in primary cells and CD19+ or CD20+ cell lines. Panel A: Schematic representation of HB2198 structure. Anti-CD19 and anti-CD20 Fab domains are shown in maroon and blue, respectively. FcγR binding enhancing mutation (SD/IE) are illustrated with green stars. White circles represent ACE2 domains mediating superdimerization. Panel B: Binding to human B cells was evaluated in PBMCs by incubating the cells in the presence of HB2198 and comparator antibodies as indicated for 30 minutes on ice. The cells were then stained with secondary anti-human Fcy-PE and B cell staining cocktail. B cells were identified as viable, CD3−, CD40+, CD21+ by flow cytometry. Triplicate mean±SD of geometric mean fluorescence intensity (gMFI) of anti-human IgG, Fcy specific-PE secondary antibody is shown with 4-parameter non-linear regression curve. (Panels C-E) HB2198 and comparator antibody binding to HEK293 to (Panel C) Raji WT, (Panel D) Raji CD19KO and (Panel E) Raji CD20KO cells were evaluated by flow cytometry. (F-H) HB2198 and comparator antibody binding to HEK293 (Panel F) and HEK293 transfected with human CD20 (Panel G) or human CD19 cDNA (Panel H). Geometric mean fluorescence intensity (MFI) of staining and 4 parameter logistic regression curve is shown. Representative plots are cumulative of 2-3 independent experiments.

Figure 97:
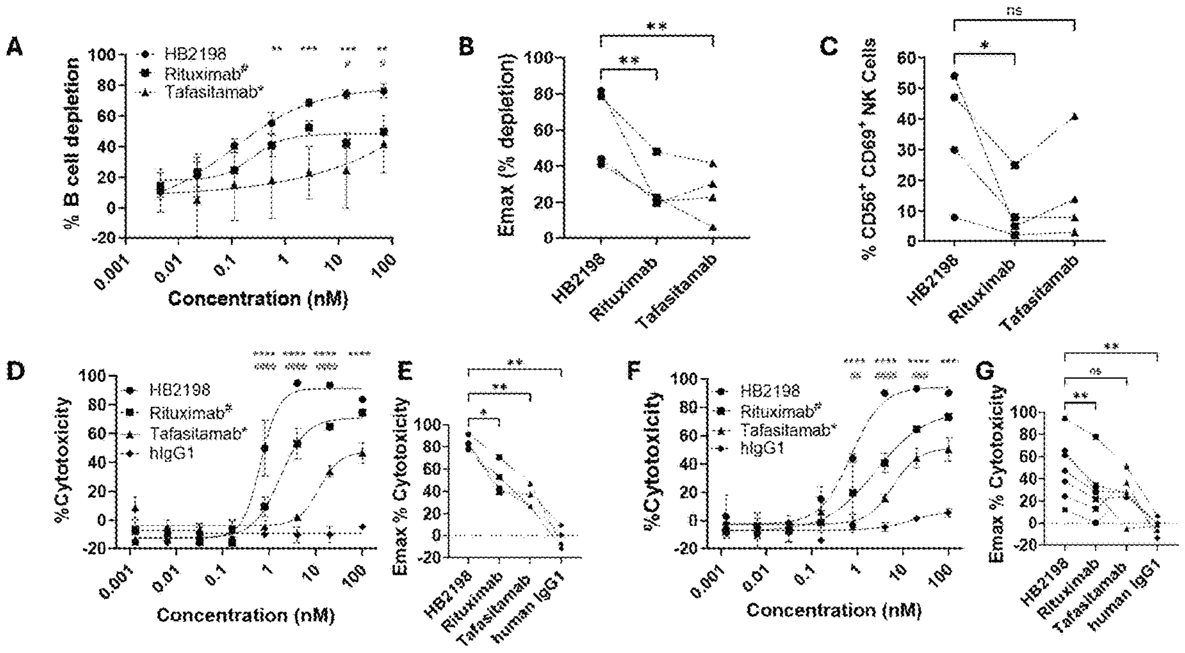

FIG. 97: HB2198 efficiently depletes B cells from human whole blood and PBMC from healthy and SLE patient donors. (Panels A-B) Human fresh whole blood was incubated overnight with HB2198 and comparator antibodies as indicated. Triplicate mean±SD of Live B cells (CD3− CD21+CD40+) were enumerated by flow cytometry. Percent B cell depletion from untreated sample B cell number with full titration curves is shown in a representative experiment (Panel A) and summary of maximum depletion in four independent experiments (B). (Panel C) NK cell activation was determined based on expression of CD69 on CD56+ NK cells by flow cytometry in the same donors as in (Panel B). (Panel D-G) Human healthy (Panel D, E) or SLE patient (Panel F, Panel G) donor PBMCs were cultured in the presence of HB2198 or comparator antibodies. A representative donor (Panel D, Panel F) and summary of maximum depletion is shown (Panel E, Panel G) of individual healthy and SLE donors, respectively. Donor matched values are compared by ANOVA using Dunnett's multiple comparison test (*$p<0.05$, **$p<0.01$).

Figure 98:
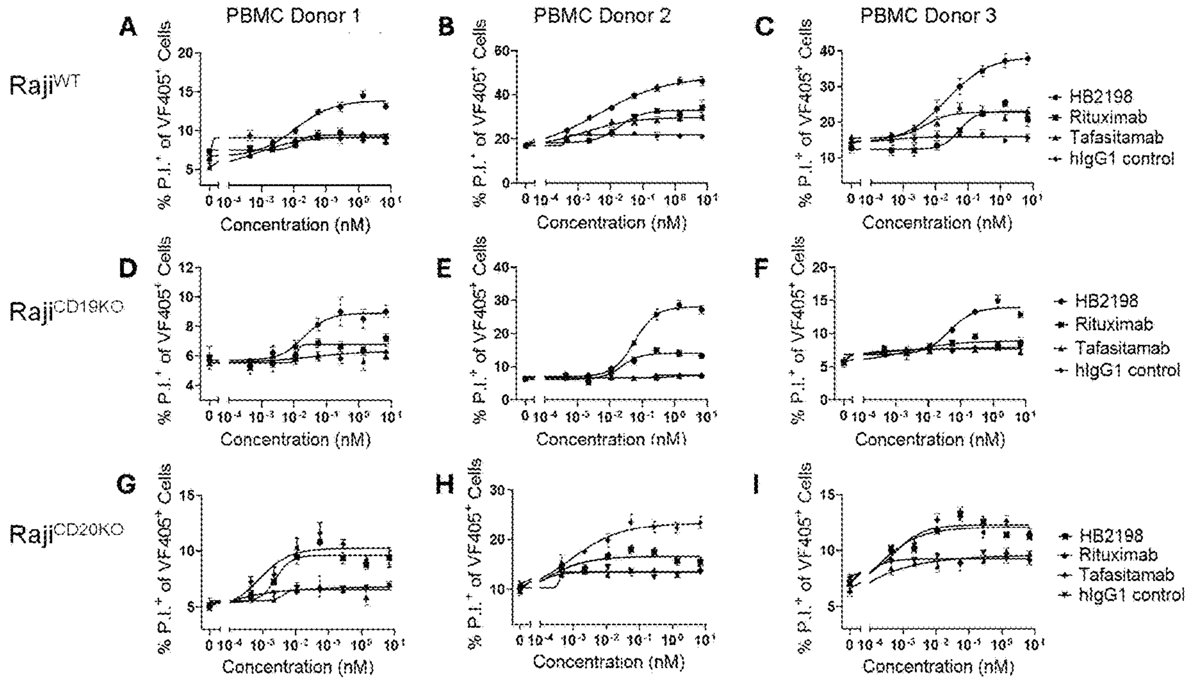

FIG. 98: HB2198 exhibits potent ADCC activity in vitro. Raji cells (Panels A-C), Raji CD19 KO (Panels D-F) and Raji CD20 KO cells (Panels G-I) were incubated with IL-2-treated human PBMCs overnight in 25:1 ratio with HB2198 and comparator antibodies as indicated. Triplicate mean±SD of percent dead (propidium iodide+) target cells by flow cytometry is graphed vs test article concentration (nM) for 3 independent PBMC donors, Donor 1 (Panels A,D,G), Donor 2 (Panels B,E,H) and Donor 3 (Panels C,F,I) as indicated and 4-parameter non-linear regression curve is shown. In each of the three donors, four highest concentrations of HB2198 resulted in higher cytotoxicity than rituximab or tafasitamab in Raji WT and Raji CD19 KO cells ($p<0.01$). In Raji CD20KO cells, HB2198 resulted in higher cytotoxicity when compared rituximab ($p<0.01$) but not when compared to tafasitamab. Values are compared by ANOVA using Dunnett's multiple comparison test ($^{*,\#}p<0.05$, $^{**,\#\#}p<0.01$).

Figure 99:
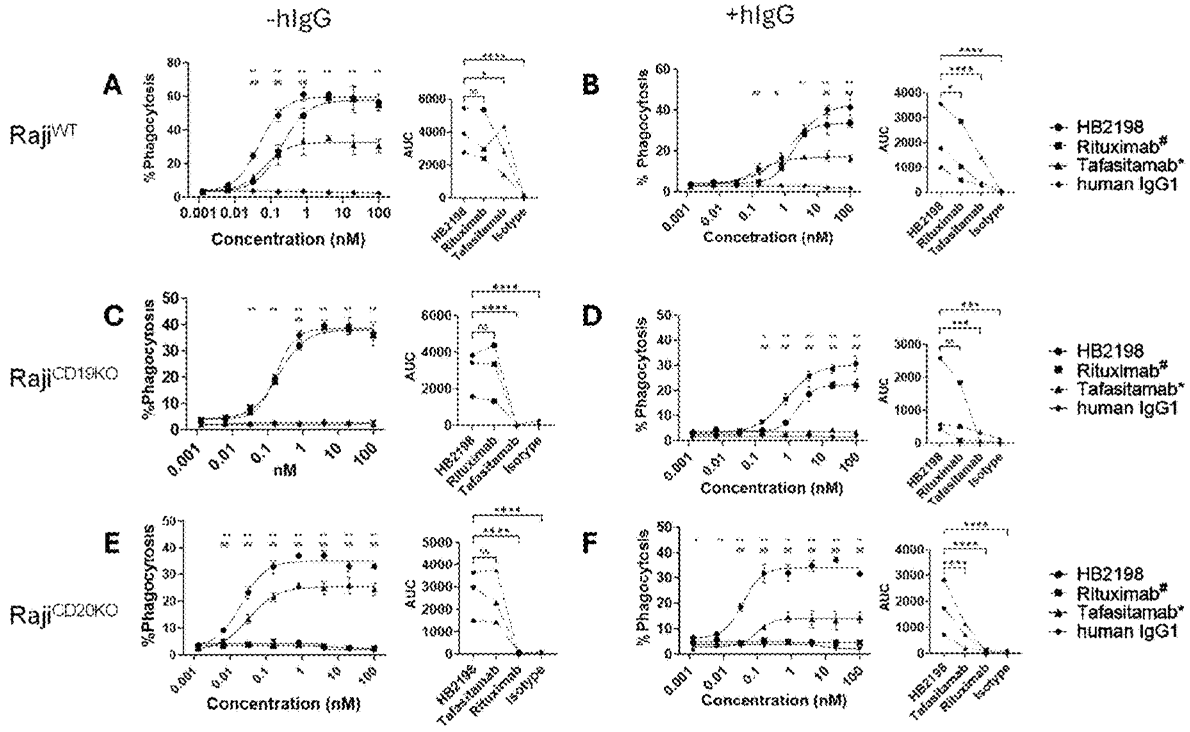

FIG. 99: HB2198 induces potent ADCP activity invitro. Raji WT cells (Panels A,B), Raji CD19 KO cells (Panels C,D) and Raji CD20 KO cells (Panels E,F) were incubated with human M2 macrophages for 2 hours in 1:2 ratio with HB2198 (circles), rituximab (squares), tafasitamab (triangles), isotype control hIgG1 (diamonds). In each graph, triplicate mean±SD of percent of macrophages positive for target cells by flow cytometry is shown with full titration in a representative experiment combined with a summary of AUC values in 3 independent PBMC CD14+ donors. Similar cultures were performed using the same PBMC donors in the absence (Panels A,C,E) and presence (Panels B,D,F) of 10 mg/mL human IgG. Values are compared by ANOVA using Dunnett's multiple comparison test ($^{*,\#}p<0.05$, $^{**,\#\#}p<0.01$).

Figure 100:
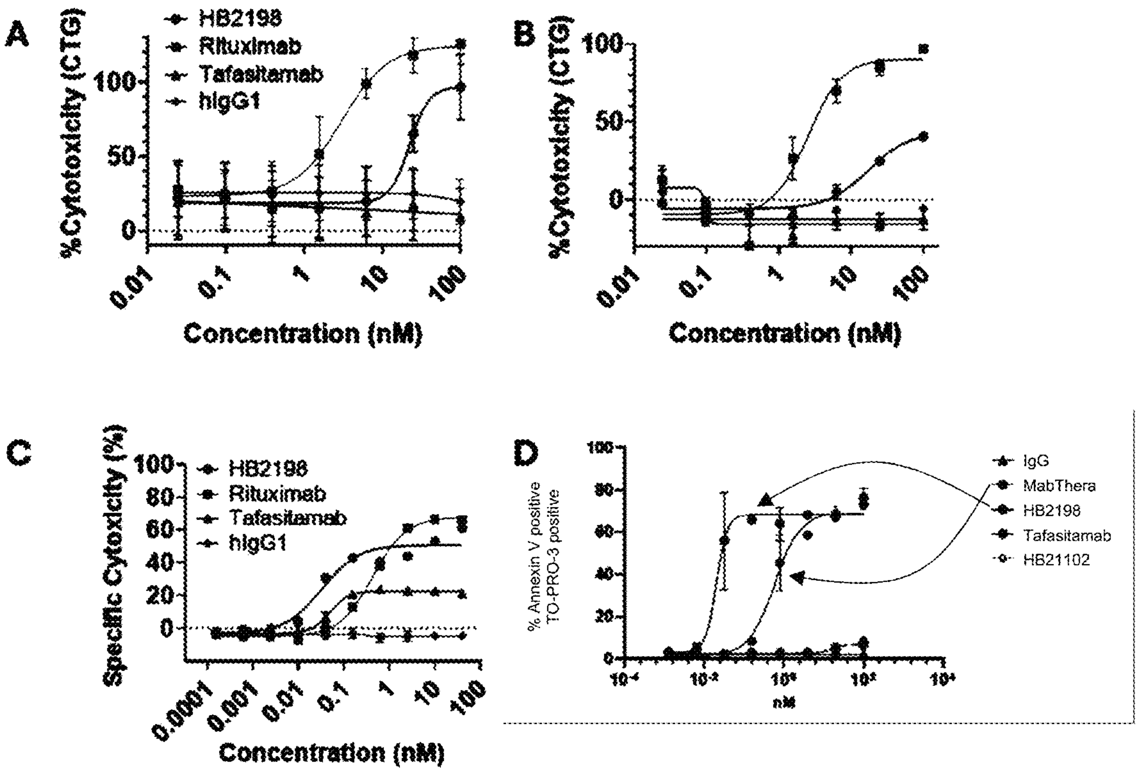

FIG. 100: HB2198 induces CDC and direct cytotoxicity in vitro. To evaluate CDC activity, (Panel A) Raji WT cells or (B) SU-DHL-4 cells were incubated with 20% human serum as a source of complement and with HB2198 (blue circles), rituximab (orange squares), tafasitamab (purple triangles), isotype hIgG1 (black diamonds). (Panels C-D) To evaluate effector cell-independent direct cytotoxic activity, SU-DHL-4 cells were cultured for 48-72 hours with test articles alone and cell number determined by ATP luminescence (Panel C) or stained for Annexin V and propidium iodide and analyzed by flow cytometry (Panel D). Percentages of dead cells are shown across titration of antibody and 4-parameter non-linear regression curve shown. Values are compared by ANOVA using Dunnett's multiple comparison test (*p<0.05, **p<0.01).

Figure 101:
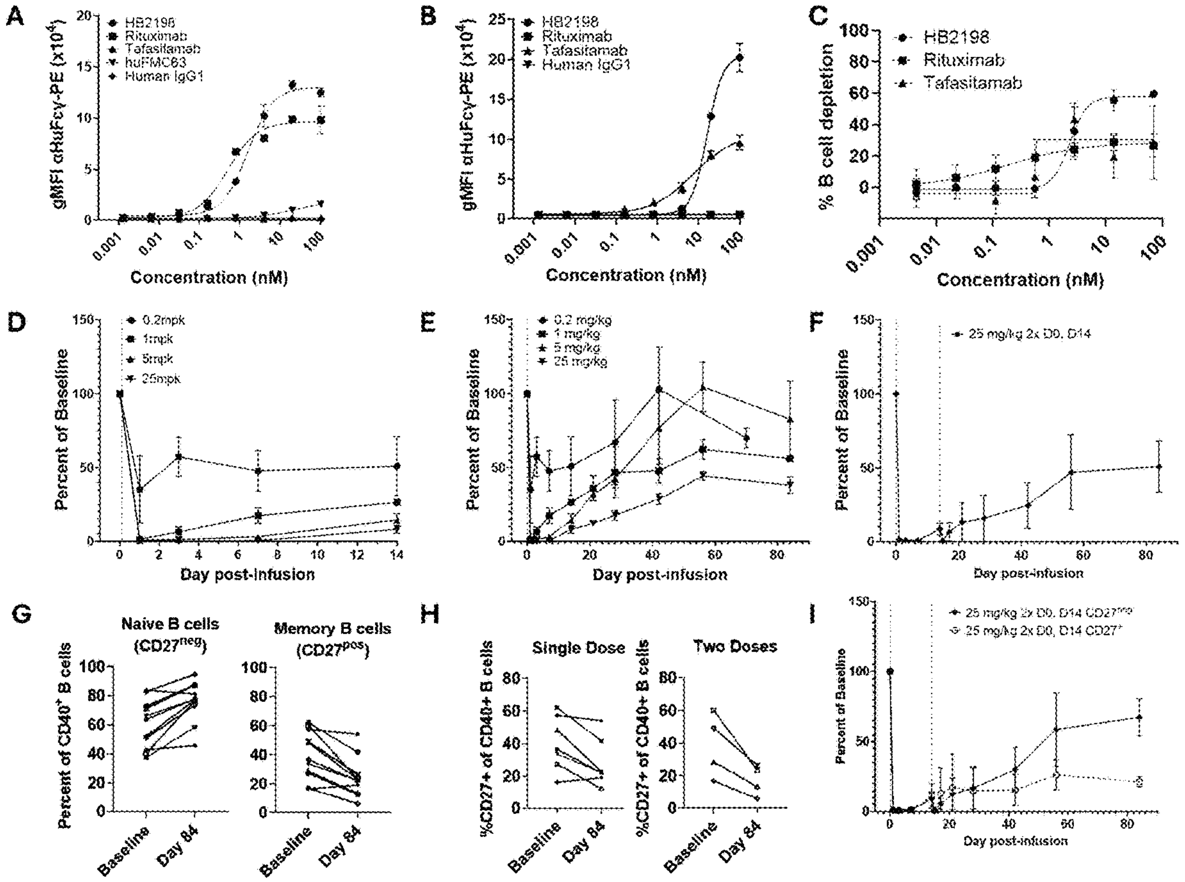

FIG. 101: HB2198 binds to cynomolgus monkey B cells and is highly active in depleting B cells in vivo. (Panels A-B) HB2198 binding in cynomolgus monkey PBMCs (Panel A) or HEK293 stably transfected with cynomolgus monkey CD19 cDNA (Panel B). (Panel C) HB2198 depletion of B cells (CD3−CD40+) in cynomolgus whole blood after overnight culture. (Panels D-F) Pharmacodynamic effect of HB2198 on circulating B cells in cynomolgus monkeys in vivo. Cynomolgus monkeys were treated with a single HB2198 dose of 0.2, 1, 5, 25 mg/kg or repeated dose of 25 mg/kg on Days 0 and 14. 100 μL fresh whole blood was collected for flow cytometry analysis pre and post infusion at indicated time points. B cells were defined as live, CD45+ lymphocytes that are CD3− CD14− CD56− CD159a− CD40+. Average percent of baseline B cell number in cohorts of cynomolgus blood for single infusion (Panels D,E) and repeated infusion, (25 mg/kg on Day 0 and Day 14) (F) is graphed over time. (Panels G-I) The proportion of CD27-negative (naïve) and CD27+ (Memory) expressing B cells before and after 3 months (Day 84) post infusion in individual animals following a single infusion (Panel G) and repeated infusion (Panel H). Time course of repeat dose animals is shown (Panel I) Values are compared by ANOVA using Dunnett's multiple comparison test (*p<0.05, **p<0.01).

Figure 102:
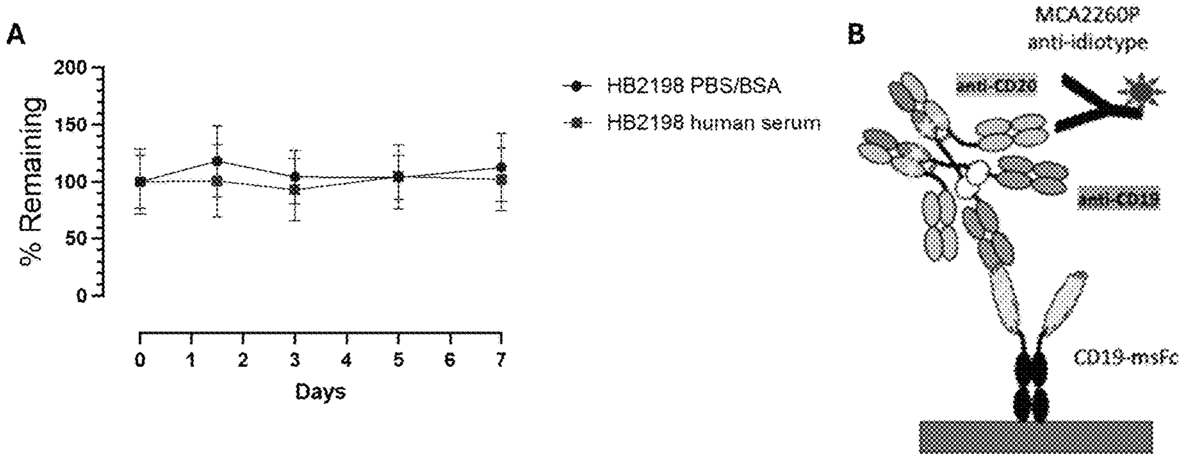

FIG. 102: Stability of HB2198 in buffer and serum at 37° C. HB2198 was incubated at 25 μg/mL in PBS containing 1% BSA (circles) or normal human serum (squares). Aliquots were taken at time 0, 1.5, 3, 5 and 7 days, and analyzed by ELISA using CD19 capture and human Fc detection. Results are expressed as % of HB2198 remaining compared to time 0.

Figure 103:
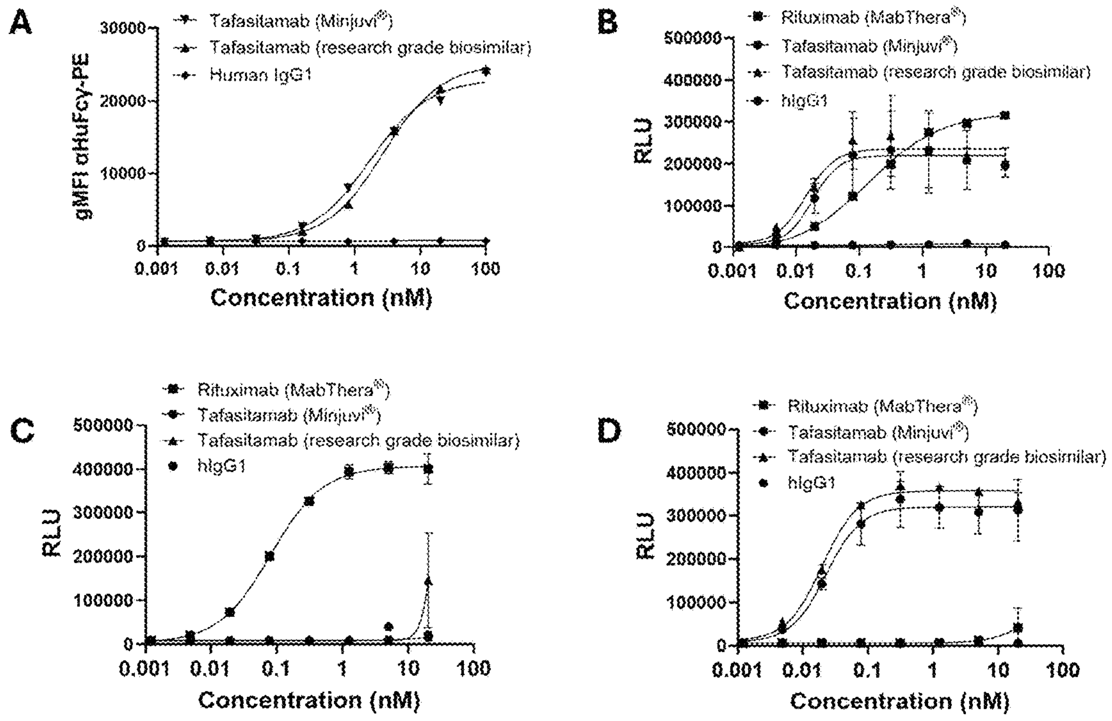

FIG. 103: Functional comparability of research grade biosimilar and pharmaceutical grade tafasitamab (Minjuvi®). (Panel A) Research grade tafasitamab has similar cell binding and ADCC activity to Minjuvi (Tafasitamab). RAJI cells (Panel A), CD19KO RAJI cells (Panel B) and CD20KO RAJI cells (Panel C) were incubated with FcγRIIIa 158V reporter cells in a 3:1 ratio for 5 hours with MabThera (squares), tafasitamab (triangles), Minjuvi (circles), isotype hIgG1 (diamonds). Duplicate mean+−standard deviation of Relative Luciferase unit (RLU) is graphed vs test article concentration (nM).

Figure 104:
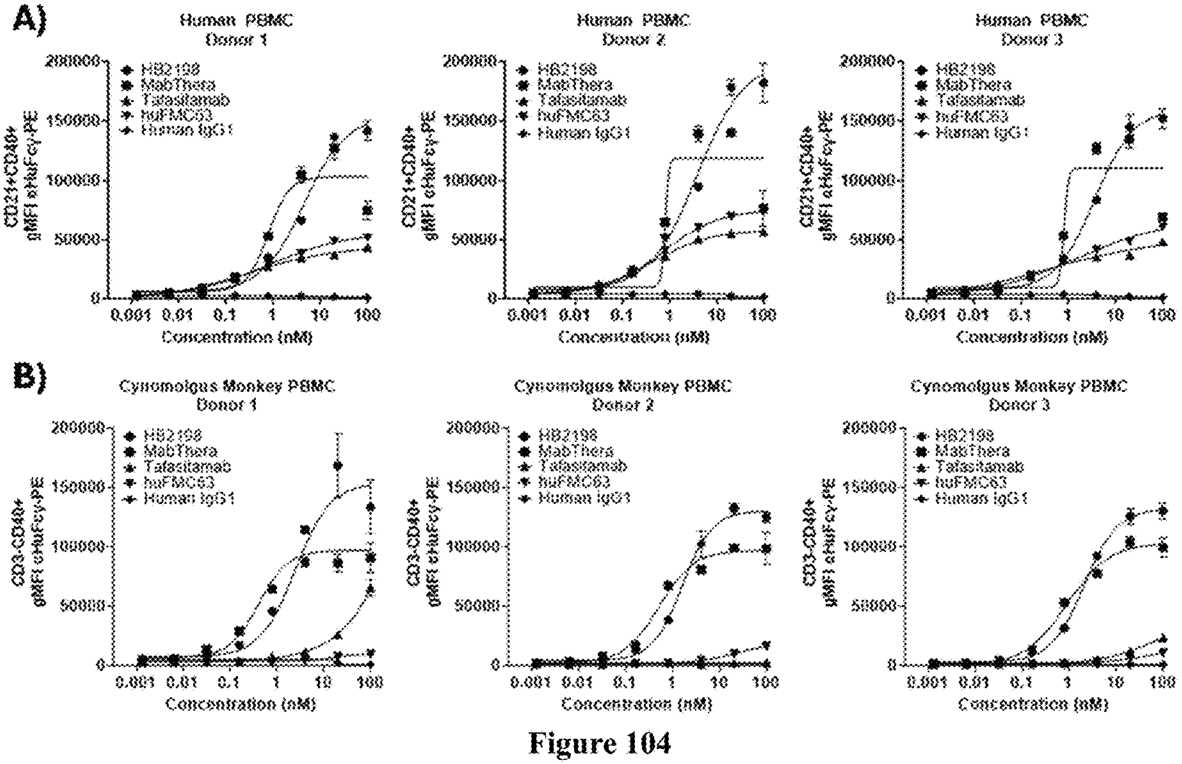

FIG. 104: Binding of HB2198, rituximab, huFMC63 and tafasitamab to Human and Cynomolgus PBMC B Cells. $1\times10^5$ human (Panel A) or healthy cynomolgus monkey (Panel B) PBMCs from 3 donors each were incubated with varying concentrations of HB2198 (circles), MabThera (squares), tafasitamab (triangles), huFMC63 (triangles), or human IgG1 isotype control (diamonds) for 30 minutes on ice, washed and stained with phycoerythrin (PE) labeled anti-human Fcγ antibody and B cell staining cocktail, and analyzed by flow cytometry. B cells were identified as viable, CD3−, CD40+, CD21+ by flow cytometry. Geometric mean fluorescence intensity (gMFI) of PE is plotted vs test article concentration with 4-parameter logistic regression curve. Means of triplicate values±SD of 3 individual donors from each species are shown.

Figure 105:
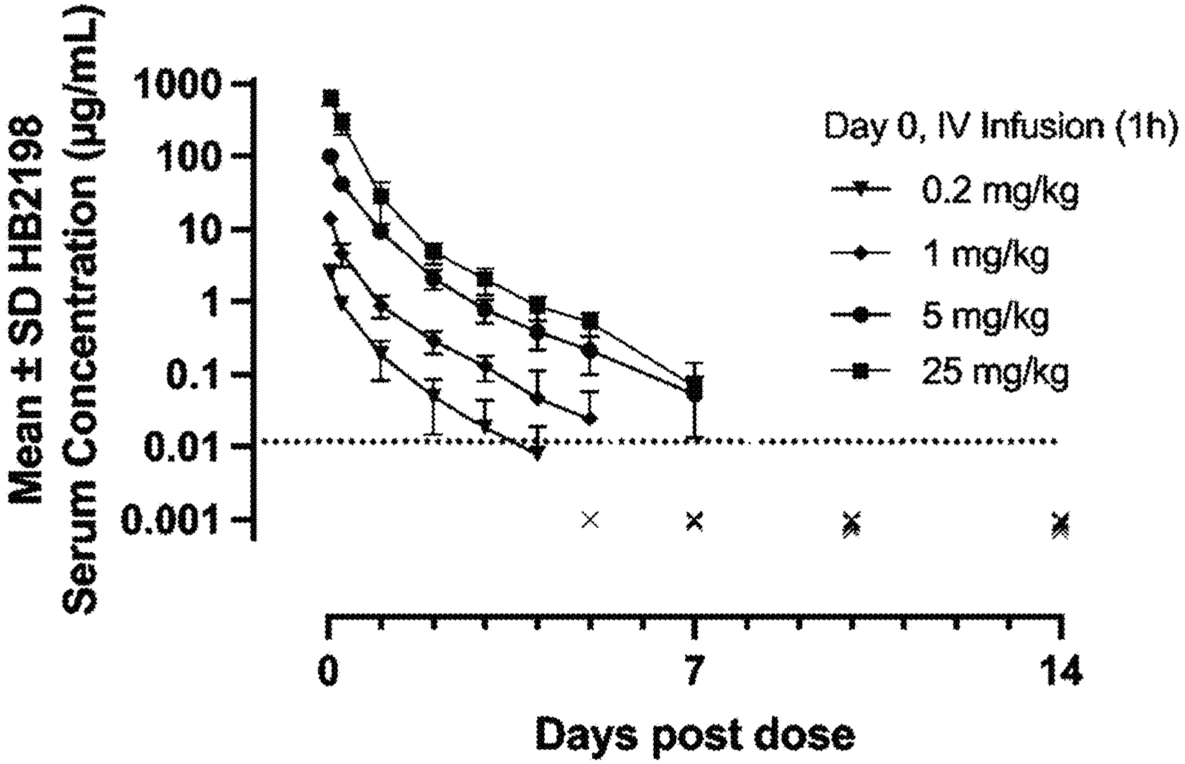

FIG. 105: Mean±SD HB2198 Serum Levels Following Single IV Infusion (1 h) of 0.2 mg/kg, 1 mg/kg, 5 mg/kg, or 25 mg/kg HB2198. HB2198 serum concentrations were measured using TP NC-0001. For 25 mg/kg cohort, n=6. For all other cohorts, n=2. Dotted line represents LLOQ (0.0117 μg/mL). Symbols (X) denote time points that were BQL for indicated cohorts.

Figure 106:
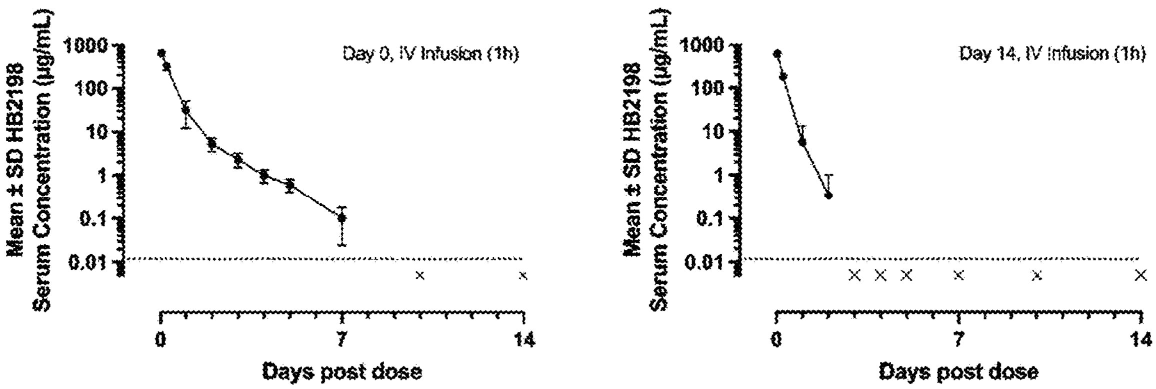

FIG. 106: Mean±SD HB2198 Serum Levels Following Repeat IV Infusion (1 h) of 25 mg/kg HB2198 on Day 0 and Day 14. HB2198 serum concentrations were measured using TP NC-0001. Dotted line represents LLOQ (0.0117 μg/mL). N=4. Symbols (X) denote time points that were BQL.

Figure 107:
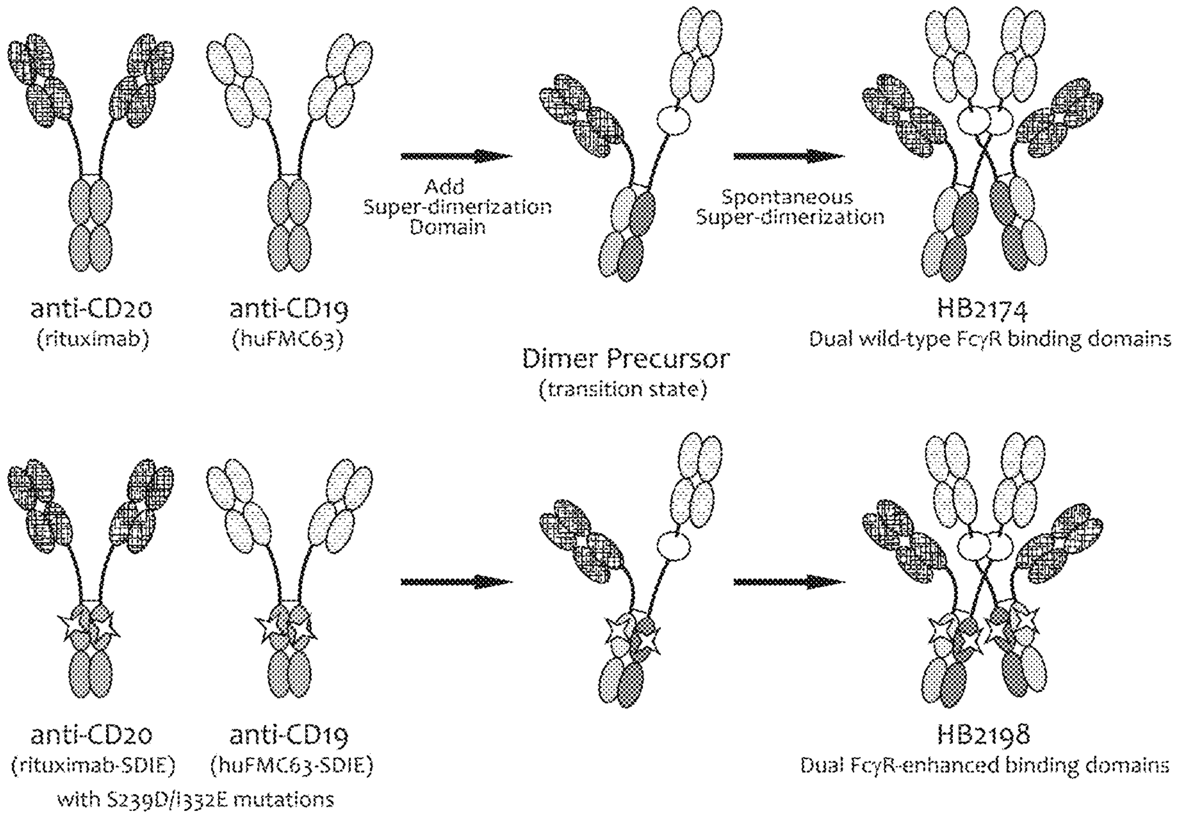

FIG. 107: Schematic representation of the assembly of HB2174 and HB2198 from dimer precursors including anti-CD20 and anti-CD19 Fab domains.

Figure 108:
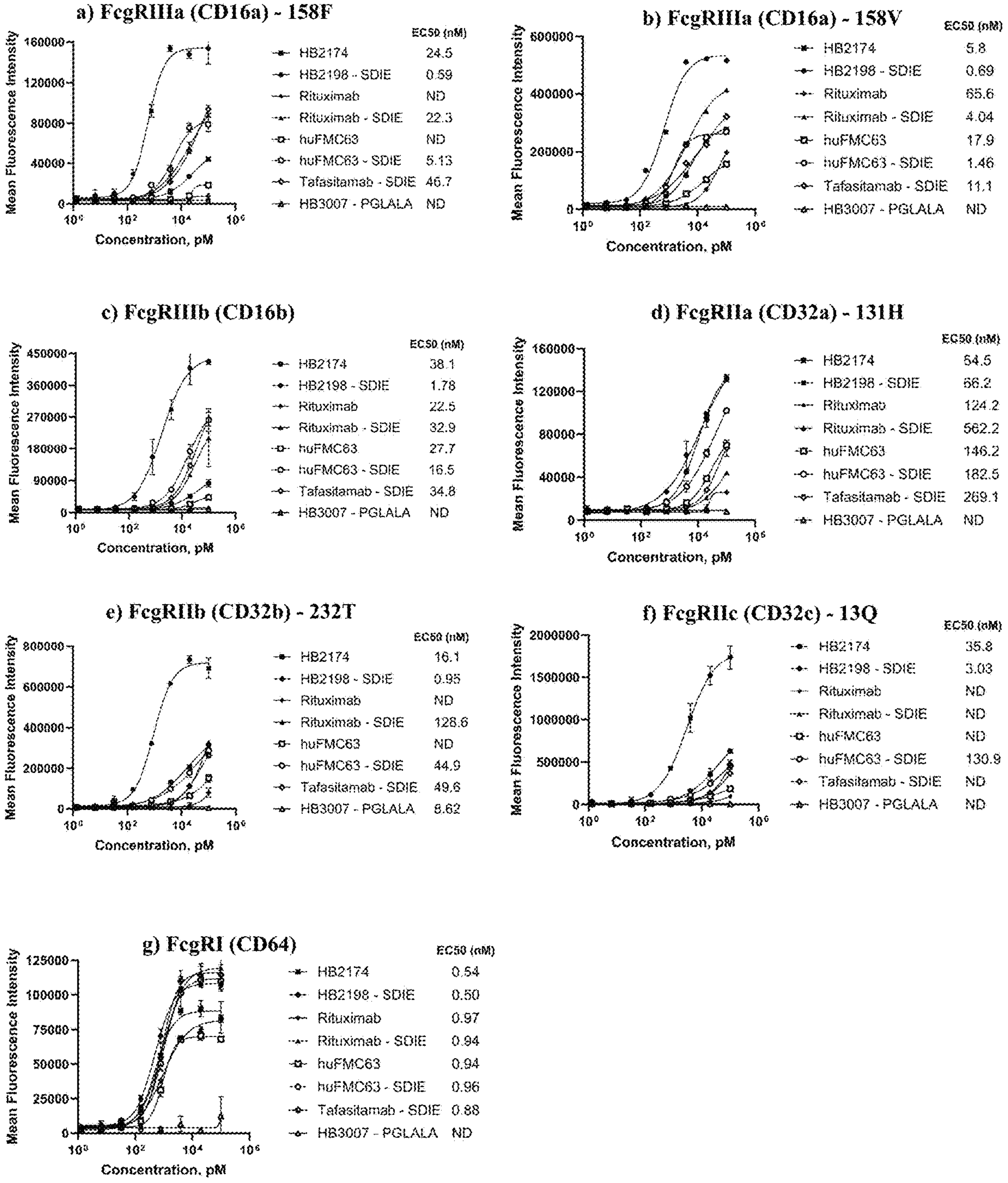

FIG. 108: Bivalent binding affinities of tetrahedral antibodies to cell surface human Fc gamma receptor proteins determined by whole cell binding studies using Chinese Hamster Ovary (CHO) cell lines expressing individual recombinant human Fc gamma receptors, CHO-K1/CD16a-158F (Catalog No. M00586), CHO-K1/CD16a-158V (Catalog No. M00597), CHO-K1/CD16b NA1 (Catalog No. M00602), CHO-K1/CD32a-131H (Catalog No. M00598), CHO-K1/CD32b-232Thr (Catalog No. M00600), CHO-K1/CD32C-13Gln (Catalog No. 601) and CHO-K1/CD64 (Catalog. No. 588) (Genscript, Piscataway, New Jersey). SDIE refers to presence of S239D and I332E mutations.

DETAILED DESCRIPTION OF THE INVENTION

NK/Monocyte Engagers

Aspect 1: This invention provides a tetrahedral antibody comprising a first, second, third, fourth, fifth, and sixth domain, wherein:

a) each of the first and second domains are an Fc domain of an IgG antibody and comprise:
   i) a first polypeptide chain comprising a first N-terminus and a first C-terminus of the domain,
   ii) a second polypeptide chain comprising a second N-terminus and a second C-terminus of the domain, and iii) S239D and I332E mutations on both the first polypeptide chain and second polypeptide chain of the domain;

b) the first domain and the second domain are joined to each other by a non-covalent linkage between a first collectrin-like domain polypeptide attached by a peptide bond or via a peptide linker to the first N-terminus of the first domain, and a second collectrin-like domain polypeptide attached by a peptide bond or via a peptide linker to the first N-terminus of the second domain;

c) the third domain is a Fab domain comprising the V region of a Fab domain of FMC59 or a variant thereof with at least 95% identity to said V region, which Fab domain is attached at its C-terminus by a peptide bond or via a peptide linker to the N-terminus of the first collectrin-like domain polypeptide;

d) the fourth domain is a Fab domain comprising the V region of a Fab domain of FMC59 or a variant thereof with at least 95% identity to said V region, which Fab domain is attached at its C-terminus by a peptide bond or via a peptide linker to the N-terminus of the second collectrin-like domain polypeptide;

e) the fifth domain is a Fab domain comprising the V region of a Fab domain of Rituximab or a variant thereof with at least 95% identity to said V region, which Fab domain is attached at its C-terminus by a peptide bond or via a peptide linker to the second N-terminus of the first domain; and f) the sixth domain is a Fab domain comprising the V region of a Fab domain of Rituximab or a variant thereof with at least 95% identity to said V region, which Fab domain is attached at its C-terminus by a peptide bond or via a peptide linker to the second N-terminus of the second domain.

Aspect 2: In embodiments of the tetrahedral antibody:

a) the V region of a Fab domain of rituximab comprises the amino acid sequence set forth in SEQ ID NO: 7169 in a first polypeptide chain and the amino acid sequence set forth in SEQ ID NO: 7173 in a second polypeptide chain; and b) the V region of a Fab domain of FMC59 comprises amino acids 1-120 of the amino acid sequence set forth in SEQ ID NO:4777 in a first polypeptide chain and amino acids 1-107 of the amino acid sequence set forth in SEQ ID NO:4821 in a second polypeptide chain.

Aspect 3: In embodiments of the tetrahedral antibody:

a) the fifth and sixth domains each comprise complementarity determining region (CDR) sequences set forth in SEQ ID NOs: 7170-7172 in a first polypeptide chain of the domain and complementarity determining region (CDR) sequences set forth in SEQ ID NOs: 7174-7176 in a second polypeptide chain of the domain;

b) the third and fourth domains each comprise complementarity determining region (CDR) sequences set forth in amino acids 26-35, 50-65, and 98-109 of SEQ ID NO: 4777 in a first polypeptide chain of the domain and complementarity determining region (CDR) sequences set forth in amino acids 24-34, 50-56, and 89-97 of SEQ ID NO:4821 in a second polypeptide chain of the domain.

Aspect 4: In embodiments, the tetrahedral antibody is formed by four different types of polypeptide chains denoted L1, H1, L2, and H2, wherein:

a) the C-terminal portion of the H1 and H2 chains pair with one another to form each of the first and second domains, b) the N-terminal portion of the H1 chain pairs with the L1 chains to form each of the third and fourth domains, c) the N-terminal portion of the H2 chain pairs with the L2 chains to form each of the fifth and sixth domains, d) the H1 chain contains the collectrin-like domain polypeptide between the portion of the H1 chain that pairs with the H2 chain and the portion that pairs with the L1 chain; and e) the L1 chain comprises the amino acid sequence set forth in SEQ ID NO: 4819, the H1 chain comprises the amino acid sequence set forth in SEQ ID NO: 4775, the L2 chain comprises the amino acid sequence set forth in SEQ ID NO: 4810, and the H2 chain comprises the amino acid sequence set forth in SEQ ID NO: 4730.

Aspect 5: This invention also provides one or more vectors comprising polynucleotides which encode polypeptides comprising the four different types of polypeptide chains of Aspect 4, wherein each polynucleotide is operably linked to a promoter which directs expression of the polynucleotide in a host cell.

This invention also provides a host cell comprising the one or more vectors of Aspect 5.

Aspect 7: This invention also provides a method of producing a tetrahedral antibody, the method comprising recombinantly expressing the four different types of polypeptide chains of Aspect 4 in a host cell.

Aspect 8: This invention also provides a pharmaceutical composition comprising the tetrahedral antibody of Aspect 4 and one or more pharmaceutically acceptable excipients.

Aspect 9: This invention also provides a method of treating B cell cancer in a subject, the method comprising administering to the subject a therapeutically effective amount of the pharmaceutical composition of Aspect 8.

Aspect 10: This invention also provides a method of treating inflammatory disease in a subject, the method comprising administering to the subject a therapeutically effective amount of the pharmaceutical composition of Aspect 8.

Aspect 11: This invention also provides a method of treating B cell disease in a subject, the method comprising administering to the subject a therapeutically effective amount of the pharmaceutical composition of Aspect 8.

Topologically Engineered Superdimeric Antibodies

This invention also provides a tetrahedral antibody comprising a first, second, third, fourth, fifth, and sixth domain, wherein:

a) each of the first and second domains are an Fc domain and comprise:

i) a first polypeptide chain comprising a first N-terminus and a first C-terminus of the domain, and ii) a second polypeptide chain comprising a second N-terminus and a second C-terminus of the domain, b) the third, fourth, fifth, and sixth domains are Fab domains, c) the first domain and the second domain are joined to each other by a non-covalent linkage between a first collectrin-like domain polypeptide attached by a peptide bond or via a peptide linker to the first N-terminus of the first domain, and a second collectrin-like domain polypeptide attached by a peptide bond or via a peptide linker to the first N-terminus of the second domain;

d) the third domain is attached at its C-terminus by a peptide bond or via a peptide linker to the N-terminus of the first collectrin-like domain polypeptide, e) the fourth domain is attached at its C-terminus by a peptide bond or via a peptide linker to the N-terminus of the second collectrin-like domain polypeptide, f) the fifth domain is attached at its C-terminus by a peptide bond or via a peptide linker to the second N-terminus of the first domain, g) the sixth domain is attached at its C-terminus by a peptide bond or via a peptide linker to the second N-terminus of the second domain.

In embodiments of the invention, the first and second domains are each an Fc domain of an IgG antibody.

In embodiments of the invention, the first and second domains each comprise one or more mutations that enhance Fc gamma receptor binding activity.

In embodiments of the invention, the one or more mutations that enhance Fc gamma receptor binding activity are selected from:

a) S239D; and b) I332E.

In embodiments of the invention, the first and second domains each comprise:

a) S239D on the first polypeptide chain of the domain and I332E on the second polypeptide chain of the domain;

b) I332E on the first polypeptide chain of the domain and S239D on the second polypeptide chain of the domain; or c) S239D and I332E on both the first polypeptide chain and second polypeptide chain of the domain.

In embodiments of the invention, the first and second domains each comprise one or more mutations that reduce Fc gamma receptor binding activity.

In embodiments of the invention, the one or more mutations that reduce Fc gamma receptor binding activity are selected from:

a) P329G/L234A/L235A (PGLALA), b) L234A/L235A (LALA), c) P331S/L234A/L235A, d) L234F/L235E/P331S, and e) L234F/L235E/P329G.

In embodiments of the invention, the third and fourth domains each comprise:

a) the V region of a Fab domain of rituximab or a variant thereof with at least 90%, preferably at least 95% identity to said V region;

b) the V region of a Fab domain of FMC63 or a variant thereof with at least 90%, preferably at least 95% identity to said V region;

c) the V region of a Fab domain of FMC60 or a variant thereof with at least 90%, preferably at least 95% identity to said V region;

d) the V region of a Fab domain of FMC59 or a variant thereof with at least 90%, preferably at least 95% identity to said V region;

e) the V region of a Fab domain of Adalimumab or a variant thereof with at least 90%, preferably at least 95% identity to said V region;

f) the V region of a Fab domain of Ustekinumab or a variant thereof with at least 90%, preferably at least 95% identity to said V region;

g) the V region of a Fab domain of Secukinumab or a variant thereof with at least 90%, preferably at least 95% identity to said V region; or h) the V region of a Fab domain of Vedolizumab or a variant thereof with at least 90%, preferably at least 95% identity to said V region.

In embodiments of the invention, the fifth and sixth domains each comprise:

a) the V region of a Fab domain of rituximab or a variant thereof with at least 90%, preferably at least 95% identity to said V region;

b) the V region of a Fab domain of FMC63 or a variant thereof with at least 90%, preferably at least 95% identity to said V region;

c) the V region of a Fab domain of FMC60 or a variant thereof with at least 90%, preferably at least 95% identity to said V region;

d) the V region of a Fab domain of FMC59 or a variant thereof with at least 90%, preferably at least 95% identity to said V region;

e) the V region of a Fab domain of Adalimumab or a variant thereof with at least 90%, preferably at least 95% identity to said V region;

f) the V region of a Fab domain of Ustekinumab or a variant thereof with at least 90%, preferably at least 95% identity to said V region;

g) the V region of a Fab domain of Secukinumab or a variant thereof with at least 90%, preferably at least 95% identity to said V region; or h) the V region of a Fab domain of Vedolizumab or a variant thereof with at least 90%, preferably at least 95% identity to said V region.

In embodiments of the invention:

a) the third and fourth domains each comprise the V region of a Fab domain of rituximab or a variant thereof with at least 90%, preferably at least 95% identity to said V region, and the fifth and sixth domains each comprise the V region of a Fab domain of FMC63 or a variant thereof with at least 90%, preferably at least 95% identity to said V region;

b) the third and fourth domains each comprise the V region of a Fab domain of FMC63 or a variant thereof with at least 90%, preferably at least 95% identity to said V region, and the fifth and sixth domains each comprise the V region of a Fab domain of rituximab or a variant thereof with at least 90%, preferably at least 95% identity to said V region, c) the third, fourth, fifth and sixth domains each comprise the V region of a Fab domain of rituximab or a variant thereof with at least 90%, preferably at least 95% identity to said V region;

d) the third, fourth, fifth and sixth domains each comprise the V region of a Fab domain of FMC63 or a variant thereof with at least 90%, preferably at least 95% identity to said V region;

e) the third and fourth domains each comprise the V region of a Fab domain of rituximab or a variant thereof with at least 90%, preferably at least 95% identity to said V region, and the fifth and sixth domains each comprise the V region of a Fab domain of FMC60 or a variant thereof with at least 90%, preferably at least 95% identity to said V region;

f) the third and fourth domains each comprise the V region of a Fab domain of FMC60 or a variant thereof with at least 90%, preferably at least 95% identity to said V region, and the fifth and sixth domains each comprise the V region of a Fab domain of rituximab or a variant thereof with at least 90%, preferably at least 95% identity to said V region;

g the third, fourth, fifth and sixth domains each comprise the V region of a Fab domain of FMC60 or a variant thereof with at least 90%, preferably at least 95% identity to said V region;

h) the third and fourth domains each comprise the V region of a Fab domain of rituximab or a variant thereof with at least 90%, preferably at least 95% identity to said V region, and the fifth and sixth domains each comprise the V region of a Fab domain of FMC59 or a variant thereof with at least 90%, preferably at least 95% identity to said V region;

i) the third and fourth domains each comprise the V region of a Fab domain of FMC59 or a variant thereof with at least 90%, preferably at least 95% identity to said V region, and the fifth and sixth domains each comprise the V region of a Fab domain of rituximab or a variant thereof with at least 90%, preferably at least 95% identity to said V region; or j) the third, fourth, fifth and sixth domains each comprise the V region of a Fab domain of FMC59 or a variant thereof with at least 90%, preferably at least 95% identity to said V region.

In embodiments of the immediately preceding embodiment of the invention, the first and second domains are each an Fc domain of an IgG antibody. In embodiments, the first and second domains each comprise one or more mutations that enhance Fc gamma receptor activity. In embodiments, the one or more mutations that enhance Fc gamma receptor activity are selected from:

a) S239D; and b) I332E.

In embodiments of the immediately preceding embodiment of the invention, the first and second domains each comprise:

a) S239D on the first polypeptide chain of the domain and I332E on the second polypeptide chain of the domain;

b) I332E on the first polypeptide chain of the domain and S239D on the second polypeptide chain of the domain; or c) S239D and I332E on both the first polypeptide chain and second polypeptide chain of the domain.

In embodiments of the invention:

a) the first and second domains are each a wild-type Fc domain, the third and fourth domains each comprise the V region of a Fab domain of rituximab or a variant thereof with at least 90%, preferably at least 95% identity to said V region, and the fifth and sixth domains each comprise the V region of a Fab domain of FMC63 or a variant thereof with at least 90%, preferably at least 95% identity to said V region;

b) the first and second domains each comprise S239D and I332E mutations, the third and fourth domains each comprise the V region of a Fab domain of rituximab or a variant thereof with at least 90%, preferably at least 95% identity to said V region, and the fifth and sixth domains each comprise the V region of a Fab domain of FMC63 or a variant thereof with at least 90%, preferably at least 95% identity to said V region;

c) the first and second domains are each a wild-type Fc domain, the third and fourth domains each comprise the V region of a Fab domain of FMC63 or a variant thereof with at least 90%, preferably at least 95% identity to said V region, and the fifth and sixth domains each comprise the V region of a Fab domain of rituximab or a variant thereof with at least 90%, preferably at least 95% identity to said V region;

d) the first and second domains each comprise S239D and I332E mutations, the third and fourth domains each comprise the V region of a Fab domain of FMC63 or a variant thereof with at least 90%, preferably at least 95% identity to said V region, and the fifth and sixth domains each comprise the V region of a Fab domain of rituximab or a variant thereof with at least 90%, preferably at least 95% identity to said V region;

e) the first and second domains are each a wild-type Fc domain, the third, fourth, fifth and sixth domains each comprise the V region of a Fab domain of rituximab or a variant thereof with at least 90%, preferably at least 95% identity to said V region;

f) the first and second domains each comprise S239D and I332E mutations, the third, fourth, fifth and sixth domains each comprise the V region of a Fab domain of rituximab or a variant thereof with at least 90%, preferably at least 95% identity to said V region;

g) the first and second domains are each a wild-type Fc domain, the third, fourth, fifth and sixth domains each comprise the V region of a Fab domain of FMC63 or a variant thereof with at least 90%, preferably at least 95% identity to said V region;

h) the first and second domains each comprise S239D and I332E mutations, the third, fourth, fifth and sixth domains each comprise the V region of a Fab domain of FMC63 or a variant thereof with at least 90%, preferably at least 95% identity to said V region;

i) the first and second domains are each a wild-type Fc domain, the third and fourth domains each comprise the V region of a Fab domain of rituximab or a variant thereof with at least 90%, preferably at least 95% identity to said V region, and the fifth and sixth domains each comprise the V region of a Fab domain of FMC60 or a variant thereof with at least 90%, preferably at least 95% identity to said V region;

j) the first and second domains each comprise S239D and I332E mutations, the third and fourth domains each comprise the V region of a Fab domain of rituximab or a variant thereof with at least 90%, preferably at least 95% identity to said V region, and the fifth and sixth domains each comprise the V region of a Fab domain of FMC60 or a variant thereof with at least 90%, preferably at least 95% identity to said V region;

k) the first and second domains are each a wild-type Fc domain, the third and fourth domains each comprise the V region of a Fab domain of FMC60 or a variant thereof with at least 90%, preferably at least 95% identity to said V region, and the fifth and sixth domains each comprise the V region of a Fab domain of rituximab or a variant thereof with at least 90%, preferably at least 95% identity to said V region;

l) the first and second domains each comprise S239D and I332E mutations, the third and fourth domains each comprise the V region of a Fab domain of FMC60 or a variant thereof with at least 90%, preferably at least 95% identity to said V region, and the fifth and sixth domains each comprise the V region of a Fab domain of rituximab or a variant thereof with at least 90%, preferably at least 95% identity to said V region;

m) the first and second domains are each a wild-type Fc domain, the third, fourth, fifth and sixth domains each comprise the V region of a Fab domain of FMC60 or a variant thereof with at least 90%, preferably at least 95% identity to said V region;

n) the first and second domains each comprise S239D and I332E mutations, the third, fourth, fifth and sixth domains each comprise the V region of a Fab domain of FMC60 or a variant thereof with at least 90%, preferably at least 95% identity to said V region;

o) the first and second domains are each a wild-type Fc domain, the third and fourth domains each comprise the V region of a Fab domain of rituximab or a variant thereof with at least 90%, preferably at least 95% identity to said V region, and the fifth and sixth domains each comprise the V region of a Fab domain of FMC59 or a variant thereof with at least 90%, preferably at least 95% identity to said V region;

p) the first and second domains each comprise S239D and I332E mutations, the third and fourth domains each comprise the V region of a Fab domain of rituximab or a variant thereof with at least 90%, preferably at least 95% identity to said V region, and the fifth and sixth domains each comprise the V region of a Fab domain of FMC59 or a variant thereof with at least 90%, preferably at least 95% identity to said V region;

q) the first and second domains are each a wild-type Fc domain, the third and fourth domains each comprise the V region of a Fab domain of FMC59 or a variant thereof with at least 90%, preferably at least 95% identity to said V region, and the fifth and sixth domains each comprise the V region of a Fab domain of rituximab or a variant thereof with at least 90%, preferably at least 95% identity to said V region;

r) the first and second domains each comprise S239D and I332E mutations, the third and fourth domains each comprise the V region of a Fab domain of FMC59 or a variant thereof with at least 90%, preferably at least 95% identity to said V region, and the fifth and sixth domains each comprise the V region of a Fab domain of rituximab;

s) the first and second domains are each a wild-type Fc domain, the third, fourth, fifth and sixth domains each comprise the V region of a Fab domain of FMC59 or a variant thereof with at least 90%, preferably at least 95% identity to said V region; or t) the first and second domains each comprise S239D and I332E mutations, the third, fourth, fifth and sixth domains each comprise the V region of a Fab domain of FMC59 or a variant thereof with at least 90%, preferably at least 95% identity to said V region.

In embodiments of the immediately preceding embodiment of the invention, the first and second domains each comprise S239D and I332E on both the first polypeptide chain and second polypeptide chain of the domain.

In embodiments of the invention:

a) the V region of a Fab domain of rituximab comprises the amino acid sequence set forth in SEQ ID NO: 7169 in a first polypeptide chain and the amino acid sequence set forth in SEQ ID NO: 7173 in a second polypeptide chain;

b) the V region of a Fab domain of FMC63 comprises amino acids 1-120 of the amino acid sequence set forth in SEQ ID NO:4741 in a first polypeptide chain and amino acids 1-107 of the amino acid sequence set forth in SEQ ID NO:4812 in a second polypeptide chain;

c) the V region of a Fab domain of FMC60 comprises amino acids 1-120 of the amino acid sequence set forth in SEQ ID NO:4777 in a first polypeptide chain and amino acids 1-107 of the amino acid sequence set forth in SEQ ID NO:4818 in a second polypeptide chain; and d) the V region of a Fab domain of FMC59 comprises amino acids 1-120 of the amino acid sequence set forth in SEQ ID NO:4777 in a first polypeptide chain and amino acids 1-107 of the amino acid sequence set forth in SEQ ID NO:4821 in a second polypeptide chain.

In embodiments of the immediately preceding embodiment of the invention:

a) if the third, fourth, fifth or sixth domain comprises the V region of a Fab domain of rituximab or a variant thereof with at least 90% or at least 95% identity to said V region, said domain comprises complementarity determining region (CDR) sequences set forth in SEQ ID NOs: 7170-7172 in a first polypeptide chain of the domain and complementarity determining region (CDR) sequences set forth in SEQ ID NOs: 7174-7176 in a second polypeptide chain of the domain;

b) if the third, fourth, fifth or sixth domain comprises the V region of a Fab domain of FMC63 or a variant thereof with at least 90% or at least 95% identity to said V region, said domain comprises complementarity determining region (CDR) sequences set forth in amino acids 26-35, 50-65, and 98-109 of SEQ ID NO: 4741 in a first polypeptide chain of the domain and complementarity determining region (CDR) sequences set forth in amino acids 24-34, 50-56, and 89-97 of SEQ ID NO:4812 in a second polypeptide chain of the domain;

c) if the third, fourth, fifth or sixth domain comprises the V region of a Fab domain of FMC60 or a variant thereof with at least 90% or at least 95% identity to said V region, said domain comprises complementarity determining region (CDR) sequences set forth in amino acids 26-35, 50-65, and 98-109 of SEQ ID NO: 4777 in a first polypeptide chain of the domain and complementarity determining region (CDR) sequences set forth in amino acids 24-34, 50-56, and 89-97 of SEQ ID NO: 4818 in a second polypeptide chain of the domain; and d) if the third, fourth, fifth or sixth domain comprises the V region of a Fab domain of FMC59 or a variant thereof with at least 90% or at least 95% identity to said V region, said domain comprises complementarity determining region (CDR) sequences set forth in amino acids 26-35, 50-65, and 98-109 of SEQ ID NO: 4777 in a first polypeptide chain of the domain and complementarity determining region (CDR) sequences set forth in amino acids 24-34, 50-56, and 89-97 of SEQ ID NO:4821 in a second polypeptide chain of the domain.

In embodiments of the invention:

a) if the third, fourth, fifth or sixth domain comprises the V region of a Fab domain of rituximab or a variant thereof with at least 90% or at least 95% identity to said V region, said domain comprises complementarity determining region (CDR) sequences set forth in SEQ ID NOs: 7170-7172 in a first polypeptide chain of the domain and complementarity determining region (CDR) sequences set forth in SEQ ID NOs: 7174-7176 in a second polypeptide chain of the domain;

b) if the third, fourth, fifth or sixth domain comprises the V region of a Fab domain of FMC63 or a variant thereof with at least 90% or at least 95% identity to said V region, said domain comprises complementarity determining region (CDR) sequences set forth in amino acids 26-35, 50-65, and 98-109 of SEQ ID NO: 4741 in a first polypeptide chain of the domain and complementarity determining region (CDR) sequences set forth in amino acids 24-34, 50-56, and 89-97 of SEQ ID NO:4812 in a second polypeptide chain of the domain;

c) if the third, fourth, fifth or sixth domain comprises the V region of a Fab domain of FMC60 or a variant thereof with at least 90% or at least 95% identity to said V region, said domain comprises complementarity determining region (CDR) sequences set forth in amino acids 26-35, 50-65, and 98-109 of SEQ ID NO: 4777 in a first polypeptide chain of the domain and complementarity determining region (CDR) sequences set forth in amino acids 24-34, 50-56, and 89-97 of SEQ ID NO: 4818 in a second polypeptide chain of the domain; and d) if the third, fourth, fifth or sixth domain comprises the V region of a Fab domain of FMC59 or a variant thereof with at least 90% or at least 95% identity to said V region, said domain comprises complementarity determining region (CDR) sequences set forth in amino acids 26-35, 50-65, and 98-109 of SEQ ID NO: 4777 in a first polypeptide chain of the domain and complementarity determining region (CDR) sequences set forth in amino acids 24-34, 50-56, and 89-97 of SEQ ID NO:4821 in a second polypeptide chain of the domain.

In embodiments of the invention, the tetrahedral antibody is formed by four different types of polypeptide chains denoted L1, H1, L2, and H2, wherein:

a) the C-terminal portion of the H1 and H2 chains pair with one another to form each of the first and second domains, b) the N-terminal portion of the H1 chain pairs with the L1 chains to form each of the third and fourth domains, c) the N-terminal portion of the H2 chain pairs with the L2 chains to form each of the fifth and sixth domains, and d) the H1 chain contains the collectrin-like domain polypeptide between the portion of the H1 chain that pairs with the H2 chain and the portion that pairs with the L1 chain.

In embodiments of the invention:

the L2 chain comprises the amino acid sequence set forth in SEQ ID NO: 734, and the H2 chain comprises the amino acid sequence set forth in SEQ ID NO: 708;

b) the L1 chain comprises the amino acid sequence set forth in SEQ ID NO: 735, the H1 chain comprises the amino acid sequence set forth in SEQ ID NO: 709, the L2 chain comprises the amino acid sequence set forth in SEQ ID NO: 736, and the H2 chain comprises the amino acid sequence set forth in SEQ ID NO: 710;

c) the L1 chain comprises the amino acid sequence set forth in SEQ ID NO: 735, the H1 chain comprises the amino acid sequence set forth in SEQ ID NO: 709, the L2 chain comprises the amino acid sequence set forth in SEQ ID NO: 737, and the H2 chain comprises the amino acid sequence set forth in SEQ ID NO: 711;

d) the L1 chain comprises the amino acid sequence set forth in SEQ ID NO: 738, the H1 chain comprises the amino acid sequence set forth in SEQ ID NO: 712, the L2 chain comprises the amino acid sequence set forth in SEQ ID NO: 739, and the H2 chain comprises the amino acid sequence set forth in SEQ ID NO: 713;

e) the L1 chain comprises the amino acid sequence set forth in SEQ ID NO: 740, the H1 chain comprises the amino acid sequence set forth in SEQ ID NO: 714, the L2 chain comprises the amino acid sequence set forth in SEQ ID NO: 741, and the H2 chain comprises the amino acid sequence set forth in SEQ ID NO: 715;

f) the L1 chain comprises the amino acid sequence set forth in SEQ ID NO: 740, the H1 chain comprises the amino acid sequence set forth in SEQ ID NO: 714, the L2 chain comprises the amino acid sequence set forth in SEQ ID NO: 742, and the H2 chain comprises the amino acid sequence set forth in SEQ ID NO: 716;

g) the H1 chain comprises the amino acid sequence set forth in SEQ ID NO: 4701, the H2 chain comprises the amino acid sequence set forth in SEQ ID NO: 4702, the L1 chain comprises the amino acid sequence set forth in SEQ ID NO: 4801, and the L2 chain comprises the amino acid sequence set forth in SEQ ID NO: 4802;

h) the H1 chain comprises the amino acid sequence set forth in SEQ ID NO: 4703, the H2 chain comprises the amino acid sequence set forth in SEQ ID NO: 4704, the L1 chain comprises the amino acid sequence set forth in SEQ ID NO: 4803, and the L2 chain comprises the amino acid sequence set forth in SEQ ID NO: 4804;

i) the H1 chain comprises the amino acid sequence set forth in SEQ ID NO: 4703, the H2 chain comprises the amino acid sequence set forth in SEQ ID NO: 4705, the L1 chain comprises the amino acid sequence set forth in SEQ ID NO: 4803, and the L2 chain comprises the amino acid sequence set forth in SEQ ID NO: 4805;

j) the H1 chain comprises the amino acid sequence set forth in SEQ ID NO: 4706, the H2 chain comprises the amino acid sequence set forth in SEQ ID NO: 4707, the L1 chain comprises the amino acid sequence set forth in SEQ ID NO: 4806, and the L2 chain comprises the amino acid sequence set forth in SEQ ID NO: 4807;

k) the H1 chain comprises the amino acid sequence set forth in SEQ ID NO: 4708, the H2 chain comprises the amino acid sequence set forth in SEQ ID NO: 4709, the L1 chain comprises the amino acid sequence set forth in SEQ ID NO: 4808, and the L2 chain comprises the amino acid sequence set forth in SEQ ID NO: 4809;

l) the H1 chain comprises the amino acid sequence set forth in SEQ ID NO: 4708, the H2 chain comprises the amino acid sequence set forth in SEQ ID NO: 4710, the L1 chain comprises the amino acid sequence set forth in SEQ ID NO: 4808, and the L2 chain comprises the amino acid sequence set forth in SEQ ID NO: 4810;

m) the H1 chain comprises the amino acid sequence set forth in SEQ ID NO: 4711, the H2 chain comprises the amino acid sequence set forth in SEQ ID NO: 4712, the L1 chain comprises the amino acid sequence set forth in SEQ ID NO: 4801, and the L2 chain comprises the amino acid sequence set forth in SEQ ID NO: 4802;

n) the H1 chain comprises the amino acid sequence set forth in SEQ ID NO: 4713, the H2 chain comprises the amino acid sequence set forth in SEQ ID NO: 4714, the L1 chain comprises the amino acid sequence set forth in SEQ ID NO: 4803, and the L2 chain comprises the amino acid sequence set forth in SEQ ID NO: 4804;

o) the H1 chain comprises the amino acid sequence set forth in SEQ ID NO: 4713, the H2 chain comprises the amino acid sequence set forth in SEQ ID NO: 4715, the L1 chain comprises the amino acid sequence set forth in SEQ ID NO: 4803, and the L2 chain comprises the amino acid sequence set forth in SEQ ID NO: 4805;

p) the H1 chain comprises the amino acid sequence set forth in SEQ ID NO: 4716, the H2 chain comprises the amino acid sequence set forth in SEQ ID NO: 4717, the L1 chain comprises the amino acid sequence set forth in SEQ ID NO: 4806, and the L2 chain comprises the amino acid sequence set forth in SEQ ID NO: 4807;

q) the H1 chain comprises the amino acid sequence set forth in SEQ ID NO: 4718, the H2 chain comprises the amino acid sequence set forth in SEQ ID NO: 4719, the L1 chain comprises the amino acid sequence set forth in SEQ ID NO: 4808, and the L2 chain comprises the amino acid sequence set forth in SEQ ID NO: 4809;

r) the H1 chain comprises the amino acid sequence set forth in SEQ ID NO: 4718, the H2 chain comprises the amino acid sequence set forth in SEQ ID NO: 4720, the L1 chain comprises the amino acid sequence set forth in SEQ ID NO: 4808, and the L2 chain comprises the amino acid sequence set forth in SEQ ID NO: 4810;

s) the H1 chain comprises the amino acid sequence set forth in SEQ ID NO: 4721, the H2 chain comprises the amino acid sequence set forth in SEQ ID NO: 4722, the L1 chain comprises the amino acid sequence set forth in SEQ ID NO: 4801, and the L2 chain comprises the amino acid sequence set forth in SEQ ID NO: 4802;

t) the H1 chain comprises the amino acid sequence set forth in SEQ ID NO: 4723, the H2 chain comprises the amino acid sequence set forth in SEQ ID NO: 4724, the L1 chain comprises the amino acid sequence set forth in SEQ ID NO: 4803, and the L2 chain comprises the amino acid sequence set forth in SEQ ID NO: 4804;

u) the H1 chain comprises the amino acid sequence set forth in SEQ ID NO: 4723, the H2 chain comprises the amino acid sequence set forth in SEQ ID NO: 4725, the L1 chain comprises the amino acid sequence set forth in SEQ ID NO: 4803, and the L2 chain comprises the amino acid sequence set forth in SEQ ID NO: 4805;

v) the H1 chain comprises the amino acid sequence set forth in SEQ ID NO: 4726, the H2 chain comprises the amino acid sequence set forth in SEQ ID NO: 4727, the L1 chain comprises the amino acid sequence set forth in SEQ ID NO: 4806, and the L2 chain comprises the amino acid sequence set forth in SEQ ID NO: 4807;

w) the H1 chain comprises the amino acid sequence set forth in SEQ ID NO: 4728, the H2 chain comprises the amino acid sequence set forth in SEQ ID NO: 4729, the L1 chain comprises the amino acid sequence set forth in SEQ ID NO: 4808, and the L2 chain comprises the amino acid sequence set forth in SEQ ID NO: 4809;

x) the H1 chain comprises the amino acid sequence set forth in SEQ ID NO: 4728, the H2 chain comprises the amino acid sequence set forth in SEQ ID NO: 4730, the L1 chain comprises the amino acid sequence set forth in SEQ ID NO: 4808, and the L2 chain comprises the amino acid sequence set forth in SEQ ID NO: 4810;

y) the H1 chain comprises the amino acid sequence set forth in SEQ ID NO: 4733, the H2 chain comprises the amino acid sequence set forth in SEQ ID NO: 4734, the L1 chain comprises the amino acid sequence set forth in SEQ ID NO: 4811, and the L2 chain comprises the amino acid sequence set forth in SEQ ID NO: 4811;

z) the H1 chain comprises the amino acid sequence set forth in SEQ ID NO: 4735, the H2 chain comprises the amino acid sequence set forth in SEQ ID NO: 4736, the L1 chain comprises the amino acid sequence set forth in SEQ ID NO: 4811, and the L2 chain comprises the amino acid sequence set forth in SEQ ID NO: 4811;

aa) the H1 chain comprises the amino acid sequence set forth in SEQ ID NO: 4737, the H2 chain comprises the amino acid sequence set forth in SEQ ID NO: 4738, the L1 chain comprises the amino acid sequence set forth in SEQ ID NO: 4811, and the L2 chain comprises the amino acid sequence set forth in SEQ ID NO: 4811;

bb) the H1 chain comprises the amino acid sequence set forth in SEQ ID NO: 4739, the H2 chain comprises the amino acid sequence set forth in SEQ ID NO: 4740, the L1 chain comprises the amino acid sequence set forth in SEQ ID NO: 4811, and the L2 chain comprises the amino acid sequence set forth in SEQ ID NO: 4811;

cc) the H1 chain comprises the amino acid sequence set forth in SEQ ID NO: 4743, the H2 chain comprises the amino acid sequence set forth in SEQ ID NO: 4744, the L1 chain comprises the amino acid sequence set forth in SEQ ID NO: 4812, and the L2 chain comprises the amino acid sequence set forth in SEQ ID NO: 4812;

dd) the H1 chain comprises the amino acid sequence set forth in SEQ ID NO: 4745, the H2 chain comprises the amino acid sequence set forth in SEQ ID NO: 4746, the L1 chain comprises the amino acid sequence set forth in SEQ ID NO: 4812, and the L2 chain comprises the amino acid sequence set forth in SEQ ID NO: 4812;

ee) the H1 chain comprises the amino acid sequence set forth in SEQ ID NO: 4747, the H2 chain comprises the amino acid sequence set forth in SEQ ID NO: 4748, the L1 chain comprises the amino acid sequence set forth in SEQ ID NO: 4812, and the L2 chain comprises the amino acid sequence set forth in SEQ ID NO: 4812;

ff) the H1 chain comprises the amino acid sequence set forth in SEQ ID NO: 4749, the H2 chain comprises the amino acid sequence set forth in SEQ ID NO: 4750, the L1 chain comprises the amino acid sequence set forth in SEQ ID NO: 4812, and the L2 chain comprises the amino acid sequence set forth in SEQ ID NO: 4812;

gg) the H1 chain comprises the amino acid sequence set forth in SEQ ID NO: 4695, the H2 chain comprises the amino acid sequence set forth in SEQ ID NO: 4751, the L1 chain comprises the amino acid sequence set forth in SEQ ID NO: 4803, and the L2 chain comprises the amino acid sequence set forth in SEQ ID NO: 4813;

hh) the H1 chain comprises the amino acid sequence set forth in SEQ ID NO: 4695, the H2 chain comprises the amino acid sequence set forth in SEQ ID NO: 4752, the L1 chain comprises the amino acid sequence set forth in SEQ ID NO: 4803, and the L2 chain comprises the amino acid sequence set forth in SEQ ID NO: 4814;

ii) the H1 chain comprises the amino acid sequence set forth in SEQ ID NO: 4753, the H2 chain comprises the amino acid sequence set forth in SEQ ID NO: 4751, the L1 chain comprises the amino acid sequence set forth in SEQ ID NO: 4815, and the L2 chain comprises the amino acid sequence set forth in SEQ ID NO: 4813;

jj) the H1 chain comprises the amino acid sequence set forth in SEQ ID NO: 4753, the H2 chain comprises the amino acid sequence set forth in SEQ ID NO: 4752, the L1 chain comprises the amino acid sequence set forth in SEQ ID NO: 4815, and the L2 chain comprises the amino acid sequence set forth in SEQ ID NO: 4814;

kk) the H1 chain comprises the amino acid sequence set forth in SEQ ID NO: 4754, the H2 chain comprises the amino acid sequence set forth in SEQ ID NO: 4699, the L1 chain comprises the amino acid sequence set forth in SEQ ID NO: 4816, and the L2 chain comprises the amino acid sequence set forth in SEQ ID NO: 4809;

ll) the H1 chain comprises the amino acid sequence set forth in SEQ ID NO: 4754, the H2 chain comprises the amino acid sequence set forth in SEQ ID NO: 4700, the L1 chain comprises the amino acid sequence set forth in SEQ ID NO: 4816, and the L2 chain comprises the amino acid sequence set forth in SEQ ID NO: 4810;

mm) the H1 chain comprises the amino acid sequence set forth in SEQ ID NO: 4755, the H2 chain comprises the amino acid sequence set forth in SEQ ID NO: 4699, the L1 chain comprises the amino acid sequence set forth in SEQ ID NO: 4817, and the L2 chain comprises the amino acid sequence set forth in SEQ ID NO: 4809;

nn) the H1 chain comprises the amino acid sequence set forth in SEQ ID NO: 4755, the H2 chain comprises the amino acid sequence set forth in SEQ ID NO: 4700, the L1 chain comprises the amino acid sequence set forth in SEQ ID NO: 4817, and the L2 chain comprises the amino acid sequence set forth in SEQ ID NO: 4810;

oo) the H1 chain comprises the amino acid sequence set forth in SEQ ID NO: 4756, the H2 chain comprises the amino acid sequence set forth in SEQ ID NO: 4757, the L1 chain comprises the amino acid sequence set forth in SEQ ID NO: 4803, and the L2 chain comprises the amino acid sequence set forth in SEQ ID NO: 4813;

pp) the H1 chain comprises the amino acid sequence set forth in SEQ ID NO: 4756, the H2 chain comprises the amino acid sequence set forth in SEQ ID NO: 4758, the L1 chain comprises the amino acid sequence set forth in SEQ ID NO: 4803, and the L2 chain comprises the amino acid sequence set forth in SEQ ID NO: 4814;

qq) the H1 chain comprises the amino acid sequence set forth in SEQ ID NO: 4759, the H2 chain comprises the amino acid sequence set forth in SEQ ID NO: 4757, the L1 chain comprises the amino acid sequence set forth in SEQ ID NO: 4815, and the L2 chain comprises the amino acid sequence set forth in SEQ ID NO: 4813;

rr) the H1 chain comprises the amino acid sequence set forth in SEQ ID NO: 4759, the H2 chain comprises the amino acid sequence set forth in SEQ ID NO: 4758, the L1 chain comprises the amino acid sequence set forth in SEQ ID NO: 4815, and the L2 chain comprises the amino acid sequence set forth in SEQ ID NO: 4814;

ss) the H1 chain comprises the amino acid sequence set forth in SEQ ID NO: 4760, the H2 chain comprises the amino acid sequence set forth in SEQ ID NO: 4761, the L1 chain comprises the amino acid sequence set forth in SEQ ID NO: 4816, and the L2 chain comprises the amino acid sequence set forth in SEQ ID NO: 4809;

tt) the H1 chain comprises the amino acid sequence set forth in SEQ ID NO: 4760, the H2 chain comprises the amino acid sequence set forth in SEQ ID NO: 4762, the L1 chain comprises the amino acid sequence set forth in SEQ ID NO: 4816, and the L2 chain comprises the amino acid sequence set forth in SEQ ID NO: 4810;

uu) the H1 chain comprises the amino acid sequence set forth in SEQ ID NO: 4763, the H2 chain comprises the amino acid sequence set forth in SEQ ID NO: 4761, the L1 chain comprises the amino acid sequence set forth in SEQ ID NO: 4817, and the L2 chain comprises the amino acid sequence set forth in SEQ ID NO: 4809;

vv) the H1 chain comprises the amino acid sequence set forth in SEQ ID NO: 4763, the H2 chain comprises the amino acid sequence set forth in SEQ ID NO: 4762, the L1 chain comprises the amino acid sequence set forth in SEQ ID NO: 4817, and the L2 chain comprises the amino acid sequence set forth in SEQ ID NO: 4810;

ww) the H1 chain comprises the amino acid sequence set forth in SEQ ID NO: 4764, the H2 chain comprises the amino acid sequence set forth in SEQ ID NO: 4765, the L1 chain comprises the amino acid sequence set forth in SEQ ID NO: 4803, and the L2 chain comprises the amino acid sequence set forth in SEQ ID NO: 4813;

xx) the H1 chain comprises the amino acid sequence set forth in SEQ ID NO: 4764, the H2 chain comprises the amino acid sequence set forth in SEQ ID NO: 4766, the L1 chain comprises the amino acid sequence set forth in SEQ ID NO: 4803, and the L2 chain comprises the amino acid sequence set forth in SEQ ID NO: 4814;

yy) the H1 chain comprises the amino acid sequence set forth in SEQ ID NO: 4767, the H2 chain comprises the amino acid sequence set forth in SEQ ID NO: 4765, the L1 chain comprises the amino acid sequence set forth in SEQ ID NO: 4815, and the L2 chain comprises the amino acid sequence set forth in SEQ ID NO: 4813;

zz) the H1 chain comprises the amino acid sequence set forth in SEQ ID NO: 4767, the H2 chain comprises the amino acid sequence set forth in SEQ ID NO: 4766, the L1 chain comprises the amino acid sequence set forth in SEQ ID NO: 4815, and the L2 chain comprises the amino acid sequence set forth in SEQ ID NO: 4814;

aaa) the H1 chain comprises the amino acid sequence set forth in SEQ ID NO: 4768, the H2 chain comprises the amino acid sequence set forth in SEQ ID NO: 4769, the L1 chain comprises the amino acid sequence set forth in SEQ ID NO: 4816, and the L2 chain comprises the amino acid sequence set forth in SEQ ID NO: 4809;

bbb) the H1 chain comprises the amino acid sequence set forth in SEQ ID NO: 4768, the H2 chain comprises the amino acid sequence set forth in SEQ ID NO: 4770, the L1 chain comprises the amino acid sequence set forth in SEQ ID NO: 4816, and the L2 chain comprises the amino acid sequence set forth in SEQ ID NO: 4810;

ccc) the H1 chain comprises the amino acid sequence set forth in SEQ ID NO: 4771, the H2 chain comprises the amino acid sequence set forth in SEQ ID NO: 4769, the L1 chain comprises the amino acid sequence set forth in SEQ ID NO: 4817, and the L2 chain comprises the amino acid sequence set forth in SEQ ID NO: 4809;

ddd) the H1 chain comprises the amino acid sequence set forth in SEQ ID NO: 4771, the H2 chain comprises the amino acid sequence set forth in SEQ ID NO: 4770, the L1 chain comprises the amino acid sequence set forth in SEQ ID NO: 4817, and the L2 chain comprises the amino acid sequence set forth in SEQ ID NO: 4810;

eee) the H1 chain comprises the amino acid sequence set forth in SEQ ID NO: 4723, the H2 chain comprises the amino acid sequence set forth in SEQ ID NO: 4772, the L1 chain comprises the amino acid sequence set forth in SEQ ID NO: 4803, and the L2 chain comprises the amino acid sequence set forth in SEQ ID NO: 4813;

fff) the H1 chain comprises the amino acid sequence set forth in SEQ ID NO: 4723, the H2 chain comprises the amino acid sequence set forth in SEQ ID NO: 4773, the L1 chain comprises the amino acid sequence set forth in SEQ ID NO: 4803, and the L2 chain comprises the amino acid sequence set forth in SEQ ID NO: 4814;

ggg) the H1 chain comprises the amino acid sequence set forth in SEQ ID NO: 4774, the H2 chain comprises the amino acid sequence set forth in SEQ ID NO: 4772, the L1 chain comprises the amino acid sequence set forth in SEQ ID NO: 4815, and the L2 chain comprises the amino acid sequence set forth in SEQ ID NO: 4813;

hhh) the H1 chain comprises the amino acid sequence set forth in SEQ ID NO: 4774, the H2 chain comprises the amino acid sequence set forth in SEQ ID NO: 4773, the L1 chain comprises the amino acid sequence set forth in SEQ ID NO: 4815, and the L2 chain comprises the amino acid sequence set forth in SEQ ID NO: 4814;

iii) the H1 chain comprises the amino acid sequence set forth in SEQ ID NO: 4775, the H2 chain comprises the amino acid sequence set forth in SEQ ID NO: 4729, the L1 chain comprises the amino acid sequence set forth in SEQ ID NO: 4816, and the L2 chain comprises the amino acid sequence set forth in SEQ ID NO: 4809;

jjj) the H1 chain comprises the amino acid sequence set forth in SEQ ID NO: 4775, the H2 chain comprises the amino acid sequence set forth in SEQ ID NO: 4730, the L1 chain comprises the amino acid sequence set forth in SEQ ID NO: 4816, and the L2 chain comprises the amino acid sequence set forth in SEQ ID NO: 4810;

kkk) the H1 chain comprises the amino acid sequence set forth in SEQ ID NO: 4776, the H2 chain comprises the amino acid sequence set forth in SEQ ID NO: 4729, the L1 chain comprises the amino acid sequence set forth in SEQ ID NO: 4817, and the L2 chain comprises the amino acid sequence set forth in SEQ ID NO: 4809;

lll) the H1 chain comprises the amino acid sequence set forth in SEQ ID NO: 4776, the H2 chain comprises the amino acid sequence set forth in SEQ ID NO: 4730, the L1 chain comprises the amino acid sequence set forth in SEQ ID NO: 4817, and the L2 chain comprises the amino acid sequence set forth in SEQ ID NO: 4810;

mmm) the H1 chain comprises the amino acid sequence set forth in SEQ ID NO: 4779, the H2 chain comprises the amino acid sequence set forth in SEQ ID NO: 4780, the L1 chain comprises the amino acid sequence set forth in SEQ ID NO: 4818, and the L2 chain comprises the amino acid sequence set forth in SEQ ID NO: 4818;

nnn) the H1 chain comprises the amino acid sequence set forth in SEQ ID NO: 4781, the H2 chain comprises the amino acid sequence set forth in SEQ ID NO: 4782, the L1 chain comprises the amino acid sequence set forth in SEQ ID NO: 4818, and the L2 chain comprises the amino acid sequence set forth in SEQ ID NO: 4818;

ooo) the H1 chain comprises the amino acid sequence set forth in SEQ ID NO: 4783, the H2 chain comprises the amino acid sequence set forth in SEQ ID NO: 4784, the L1 chain comprises the amino acid sequence set forth in SEQ ID NO: 4818, and the L2 chain comprises the amino acid sequence set forth in SEQ ID NO: 4818;

ppp) the H1 chain comprises the amino acid sequence set forth in SEQ ID NO: 4785, the H2 chain comprises the amino acid sequence set forth in SEQ ID NO: 4786, the L1 chain comprises the amino acid sequence set forth in SEQ ID NO: 4818, and the L2 chain comprises the amino acid sequence set forth in SEQ ID NO: 4818;

qqq) the H1 chain comprises the amino acid sequence set forth in SEQ ID NO: 4695, the H2 chain comprises the amino acid sequence set forth in SEQ ID NO: 4787, the L1 chain comprises the amino acid sequence set forth in SEQ ID NO: 4803, and the L2 chain comprises the amino acid sequence set forth in SEQ ID NO: 4813;

rrr) the H1 chain comprises the amino acid sequence set forth in SEQ ID NO: 4695, the H2 chain comprises the amino acid sequence set forth in SEQ ID NO: 4788, the L1 chain comprises the amino acid sequence set forth in SEQ ID NO: 4803, and the L2 chain comprises the amino acid sequence set forth in SEQ ID NO: 4814;

sss) the H1 chain comprises the amino acid sequence set forth in SEQ ID NO: 4753, the H2 chain comprises the amino acid sequence set forth in SEQ ID NO: 4787, the L1 chain comprises the amino acid sequence set forth in SEQ ID NO: 4815, and the L2 chain comprises the amino acid sequence set forth in SEQ ID NO: 4813;

ttt) the H1 chain comprises the amino acid sequence set forth in SEQ ID NO: 4753, the H2 chain comprises the amino acid sequence set forth in SEQ ID NO: 4788, the L1 chain comprises the amino acid sequence set forth in SEQ ID NO: 4815, and the L2 chain comprises the amino acid sequence set forth in SEQ ID NO: 4814;

uuu) the H1 chain comprises the amino acid sequence set forth in SEQ ID NO: 4754, the H2 chain comprises the amino acid sequence set forth in SEQ ID NO: 4699, the L1 chain comprises the amino acid sequence set forth in SEQ ID NO: 4819, and the L2 chain comprises the amino acid sequence set forth in SEQ ID NO: 4809;

vvv) the H1 chain comprises the amino acid sequence set forth in SEQ ID NO: 4754, the H2 chain comprises the amino acid sequence set forth in SEQ ID NO: 4700, the L1 chain comprises the amino acid sequence set forth in SEQ ID NO: 4819, and the L2 chain comprises the amino acid sequence set forth in SEQ ID NO: 4810;

www) the H1 chain comprises the amino acid sequence set forth in SEQ ID NO: 4755, the H2 chain comprises the amino acid sequence set forth in SEQ ID NO: 4699, the L1 chain comprises the amino acid sequence set forth in SEQ ID NO: 4820, and the L2 chain comprises the amino acid sequence set forth in SEQ ID NO: 4809;

xxx) the H1 chain comprises the amino acid sequence set forth in SEQ ID NO: 4755, the H2 chain comprises the amino acid sequence set forth in SEQ ID NO: 4700, the L1 chain comprises the amino acid sequence set forth in SEQ ID NO: 4820, and the L2 chain comprises the amino acid sequence set forth in SEQ ID NO: 4810;

yyy) the H1 chain comprises the amino acid sequence set forth in SEQ ID NO: 4756, the H2 chain comprises the amino acid sequence set forth in SEQ ID NO: 4789, the L1 chain comprises the amino acid sequence set forth in SEQ ID NO: 4803, and the L2 chain comprises the amino acid sequence set forth in SEQ ID NO: 4813;

zzz) the H1 chain comprises the amino acid sequence set forth in SEQ ID NO: 4756, the H2 chain comprises the amino acid sequence set forth in SEQ ID NO: 4790, the L1 chain comprises the amino acid sequence set forth in SEQ ID NO: 4803, and the L2 chain comprises the amino acid sequence set forth in SEQ ID NO: 4814;

aaaa) the H1 chain comprises the amino acid sequence set forth in SEQ ID NO: 4759, the H2 chain comprises the amino acid sequence set forth in SEQ ID NO: 4789, the L1 chain comprises the amino acid sequence set forth in SEQ ID NO: 4815, and the L2 chain comprises the amino acid sequence set forth in SEQ ID NO: 4813;

bbbb) the H1 chain comprises the amino acid sequence set forth in SEQ ID NO: 4759, the H2 chain comprises the amino acid sequence set forth in SEQ ID NO: 4790, the L1 chain comprises the amino acid sequence set forth in SEQ ID NO: 4815, and the L2 chain comprises the amino acid sequence set forth in SEQ ID NO: 4814;

cccc) the H1 chain comprises the amino acid sequence set forth in SEQ ID NO: 4760, the H2 chain comprises the amino acid sequence set forth in SEQ ID NO: 4761, the L1 chain comprises the amino acid sequence set forth in SEQ ID NO: 4819, and the L2 chain comprises the amino acid sequence set forth in SEQ ID NO: 4809;

dddd) the H1 chain comprises the amino acid sequence set forth in SEQ ID NO: 4760, the H2 chain comprises the amino acid sequence set forth in SEQ ID NO: 4762, the L1 chain comprises the amino acid sequence set forth in SEQ ID NO: 4819, and the L2 chain comprises the amino acid sequence set forth in SEQ ID NO: 4810;

eeee) the H1 chain comprises the amino acid sequence set forth in SEQ ID NO: 4763, the H2 chain comprises the amino acid sequence set forth in SEQ ID NO: 4761, the L1 chain comprises the amino acid sequence set forth in SEQ ID NO: 4820, and the L2 chain comprises the amino acid sequence set forth in SEQ ID NO: 4809;

ffff) the H1 chain comprises the amino acid sequence set forth in SEQ ID NO: 4763, the H2 chain comprises the amino acid sequence set forth in SEQ ID NO: 4762, the L1 chain comprises the amino acid sequence set forth in SEQ ID NO: 4820, and the L2 chain comprises the amino acid sequence set forth in SEQ ID NO: 4810;

gggg) the H1 chain comprises the amino acid sequence set forth in SEQ ID NO: 4764, the H2 chain comprises the amino acid sequence set forth in SEQ ID NO: 4791, the L1 chain comprises the amino acid sequence set forth in SEQ ID NO: 4803, and the L2 chain comprises the amino acid sequence set forth in SEQ ID NO: 4813;

hhhh) the H1 chain comprises the amino acid sequence set forth in SEQ ID NO: 4764, the H2 chain comprises the amino acid sequence set forth in SEQ ID NO: 4792, the L1 chain comprises the amino acid sequence set forth in SEQ ID NO: 4803, and the L2 chain comprises the amino acid sequence set forth in SEQ ID NO: 4814;

iiii) the H1 chain comprises the amino acid sequence set forth in SEQ ID NO: 4767, the H2 chain comprises the amino acid sequence set forth in SEQ ID NO: 4791, the L1 chain comprises the amino acid sequence set forth in SEQ ID NO: 4815, and the L2 chain comprises the amino acid sequence set forth in SEQ ID NO: 4813;

jjjj) the H1 chain comprises the amino acid sequence set forth in SEQ ID NO: 4767, the H2 chain comprises the amino acid sequence set forth in SEQ ID NO: 4792, the L1 chain comprises the amino acid sequence set forth in SEQ ID NO: 4815, and the L2 chain comprises the amino acid sequence set forth in SEQ ID NO: 4814;

kkkk) the H1 chain comprises the amino acid sequence set forth in SEQ ID NO: 4768, the H2 chain comprises the amino acid sequence set forth in SEQ ID NO: 4769, the L1 chain comprises the amino acid sequence set forth in SEQ ID NO: 4819, and the L2 chain comprises the amino acid sequence set forth in SEQ ID NO: 4809;

llll) the H1 chain comprises the amino acid sequence set forth in SEQ ID NO: 4768, the H2 chain comprises the amino acid sequence set forth in SEQ ID NO: 4770, the L1 chain comprises the amino acid sequence set forth in SEQ ID NO: 4819, and the L2 chain comprises the amino acid sequence set forth in SEQ ID NO: 4810;

mmmm) the H1 chain comprises the amino acid sequence set forth in SEQ ID NO: 4771, the H2 chain comprises the amino acid sequence set forth in SEQ ID NO: 4769, the L1 chain comprises the amino acid sequence set forth in SEQ ID NO: 4820, and the L2 chain comprises the amino acid sequence set forth in SEQ ID NO: 4809;

nnnn) the H1 chain comprises the amino acid sequence set forth in SEQ ID NO: 4771, the H2 chain comprises the amino acid sequence set forth in SEQ ID NO: 4770, the L1 chain comprises the amino acid sequence set forth in SEQ ID NO: 4820, and the L2 chain comprises the amino acid sequence set forth in SEQ ID NO: 4810;

oooo) the H1 chain comprises the amino acid sequence set forth in SEQ ID NO: 4723, the H2 chain comprises the amino acid sequence set forth in SEQ ID NO: 4793, the L1 chain comprises the amino acid sequence set forth in SEQ ID NO: 4803, and the L2 chain comprises the amino acid sequence set forth in SEQ ID NO: 4813;

pppp) the H1 chain comprises the amino acid sequence set forth in SEQ ID NO: 4723, the H2 chain comprises the amino acid sequence set forth in SEQ ID NO: 4794, the L1 chain comprises the amino acid sequence set forth in SEQ ID NO: 4803, and the L2 chain comprises the amino acid sequence set forth in SEQ ID NO: 4814;

qqqq) the H1 chain comprises the amino acid sequence set forth in SEQ ID NO: 4774, the H2 chain comprises the amino acid sequence set forth in SEQ ID NO: 4793, the L1 chain comprises the amino acid sequence set forth in SEQ ID NO: 4815, and the L2 chain comprises the amino acid sequence set forth in SEQ ID NO: 4813;

rrrr) the H1 chain comprises the amino acid sequence set forth in SEQ ID NO: 4774, the H2 chain comprises the amino acid sequence set forth in SEQ ID NO: 4794, the L1 chain comprises the amino acid sequence set forth in SEQ ID NO: 4815, and the L2 chain comprises the amino acid sequence set forth in SEQ ID NO: 4814;

ssss) the H1 chain comprises the amino acid sequence set forth in SEQ ID NO: 4775, the H2 chain comprises the amino acid sequence set forth in SEQ ID NO: 4729, the L1 chain comprises the amino acid sequence set forth in SEQ ID NO: 4819, and the L2 chain comprises the amino acid sequence set forth in SEQ ID NO: 4809;

tttt) the H1 chain comprises the amino acid sequence set forth in SEQ ID NO: 4775, the H2 chain comprises the amino acid sequence set forth in SEQ ID NO: 4730, the L1 chain comprises the amino acid sequence set forth in SEQ ID NO: 4819, and the L2 chain comprises the amino acid sequence set forth in SEQ ID NO: 4810;

uuuu) the H1 chain comprises the amino acid sequence set forth in SEQ ID NO: 4776, the H2 chain comprises the amino acid sequence set forth in SEQ ID NO: 4729, the L1 chain comprises the amino acid sequence set forth in SEQ ID NO: 4820, and the L2 chain comprises the amino acid sequence set forth in SEQ ID NO: 4809;

vvvv) the H1 chain comprises the amino acid sequence set forth in SEQ ID NO: 4776, the H2 chain comprises the amino acid sequence set forth in SEQ ID NO: 4730, the L1 chain comprises the amino acid sequence set forth in SEQ ID NO: 4820, and the L2 chain comprises the amino acid sequence set forth in SEQ ID NO: 4810;

wwww) the H1 chain comprises the amino acid sequence set forth in SEQ ID NO: 4779, the H2 chain comprises the amino acid sequence set forth in SEQ ID NO: 4780, the L1 chain comprises the amino acid sequence set forth in SEQ ID NO: 4821, and the L2 chain comprises the amino acid sequence set forth in SEQ ID NO: 4821;

xxxx) the H1 chain comprises the amino acid sequence set forth in SEQ ID NO: 4781, the H2 chain comprises the amino acid sequence set forth in SEQ ID NO: 4782, the L1 chain comprises the amino acid sequence set forth in SEQ ID NO: 4821, and the L2 chain comprises the amino acid sequence set forth in SEQ ID NO: 4821;

yyyy) the H1 chain comprises the amino acid sequence set forth in SEQ ID NO: 4783, the H2 chain comprises the amino acid sequence set forth in SEQ ID NO: 4784, the L1 chain comprises the amino acid sequence set forth in SEQ ID NO: 4821, and the L2 chain comprises the amino acid sequence set forth in SEQ ID NO: 4821; or zzzz) the H1 chain comprises the amino acid sequence set forth in SEQ ID NO: 4785, the H2 chain comprises the amino acid sequence set forth in SEQ ID NO: 4786, the L1 chain comprises the amino acid sequence set forth in SEQ ID NO: 4821, and the L2 chain comprises the amino acid sequence set forth in SEQ ID NO: 4821; or aaaaa) the L1, H1, L2, and H2 chains are variants with at least 90%, preferably at least 95%, more preferably at least 98% identity to said sequences.

In embodiments of the invention, the tetrahedral antibody further comprises a seventh domain and eighth domain, wherein:

a) the seventh domain and eighth domain are each single chain 4-1BB ligand trimers;

b) the seventh domain is attached at its N-terminus by a peptide bond or via a peptide linker to the first C-terminus of the first domain, and c) the eighth domain is attached at its N-terminus by a peptide bond or via a peptide linker to the first C-terminus of the second domain.

In embodiments of the immediately preceding embodiment of the invention, the tetrahedral antibody is formed by four different types of polypeptide chains denoted L1, H1, L2, and H2, wherein:

a) the H1 chain contains, from C-terminus to N-terminus:
   i) the seventh or eighth domain;
   ii) a portion which pairs with the C-terminal portion of the H2 chains to form each of the first and second domains;
   iii) the collectrin-like domain polypeptide;
   iv) a portion which pairs with the L1 chains to form each of the third and fourth domains;
b) the H2 chain contains, from C-terminus to N-terminus:
   i) a portion which pairs with the H1 chains to form each of the first and second domains; and
   ii) a portion which pairs with the L2 chains to form each of the fifth and sixth domains.

In embodiments of the immediately preceding embodiment of the invention:

a) the L1 chain comprises the amino acid sequence set forth in SEQ ID NO: 733, the H1 chain comprises the amino acid sequence set forth in SEQ ID NO: 707, the L2 chain comprises the amino acid sequence set forth in SEQ ID NO: 734, and the H2 chain comprises the amino acid sequence set forth in SEQ ID NO: 717;
b) the L1 chain comprises the amino acid sequence set forth in SEQ ID NO: 735, the H1 chain comprises the amino acid sequence set forth in SEQ ID NO: 709, the L2 chain comprises the amino acid sequence set forth in SEQ ID NO: 736, and the H2 chain comprises the amino acid sequence set forth in SEQ ID NO: 718;
c) the L1 chain comprises the amino acid sequence set forth in SEQ ID NO: 735, the H1 chain comprises the amino acid sequence set forth in SEQ ID NO: 709, the L2 chain comprises the amino acid sequence set forth in SEQ ID NO: 737, and the H2 chain comprises the amino acid sequence set forth in SEQ ID NO: 719;
d) the L1 chain comprises the amino acid sequence set forth in SEQ ID NO: 738, the H1 chain comprises the amino acid sequence set forth in SEQ ID NO: 712, the L2 chain comprises the amino acid sequence set forth in SEQ ID NO: 739, and the H2 chain comprises the amino acid sequence set forth in SEQ ID NO: 720;
e) the L1 chain comprises the amino acid sequence set forth in SEQ ID NO: 740, the H1 chain comprises the amino acid sequence set forth in SEQ ID NO: 714, the L2 chain comprises the amino acid sequence set forth in SEQ ID NO: 741, and the H2 chain comprises the amino acid sequence set forth in SEQ ID NO: 721; or
f) the L1 chain comprises the amino acid sequence set forth in SEQ ID NO: 740, the H1 chain comprises the amino acid sequence set forth in SEQ ID NO: 714, the L2 chain comprises the amino acid sequence set forth in SEQ ID NO: 742, and the H2 chain comprises the amino acid sequence set forth in SEQ ID NO: 722; or
g the L1, H1, L2, and H2 chains are variants with at least 90%, preferably at least 95%, more preferably at least 98% identity to said sequences.

In embodiments of the invention:

a) the third and fourth domains each comprise the V region of a Fab domain of Adalimumab or a variant thereof with at least 90%, preferably at least 95% identity to said V region, and the fifth and sixth domains each comprise the V region of a Fab domain of Ustekinumab or a variant thereof with at least 90%, preferably at least 95% identity to said V region;
b) the third and fourth domains each comprise the V region of a Fab domain of Ustekinumab or a variant thereof with at least 90%, preferably at least 95% identity to said V region, and the fifth and sixth domains each comprise the V region of a Fab domain of Adalimumab or a variant thereof with at least 90%, preferably at least 95% identity to said V region;
c) the third and fourth domains each comprise the V region of a Fab domain of Adalimumab or a variant thereof with at least 90%, preferably at least 95% identity to said V region, and the fifth and sixth domains each comprise the V region of a Fab domain of Secukinumab or a variant thereof with at least 90%, preferably at least 95% identity to said V region;
d) the third and fourth domains each comprise the V region of a Fab domain of Secukinumab or a variant thereof with at least 90%, preferably at least 95% identity to said V region, and the fifth and sixth domains each comprise the V region of a Fab domain of Adalimumab or a variant thereof with at least 90%, preferably at least 95% identity to said V region;
e) the third and fourth domains each comprise the V region of a Fab domain of Ustekinumab or a variant thereof with at least 90%, preferably at least 95% identity to said V region, and the fifth and sixth domains each comprise the V region of a Fab domain of Secukinumab or a variant thereof with at least 90%, preferably at least 95% identity to said V region;
f) the third and fourth domains each comprise the V region of a Fab domain of Secukinumab or a variant thereof with at least 90%, preferably at least 95% identity to said V region, and the fifth and sixth domains each comprise the V region of a Fab domain of Ustekinumab or a variant thereof with at least 90%, preferably at least 95% identity to said V region;
g) the third and fourth domains each comprise the V region of a Fab domain of Adalimumab or a variant thereof with at least 90%, preferably at least 95% identity to said V region, and the fifth and sixth domains each comprise the V region of a Fab domain of Vedolizumab or a variant thereof with at least 90%, preferably at least 95% identity to said V region; or
h) the third and fourth domains each comprise the V region of a Fab domain of Vedolizumab or a variant thereof with at least 90%, preferably at least 95% identity to said V region, and the fifth and sixth domains each comprise the V region of a Fab domain of Adalimumab or a variant thereof with at least 90%, preferably at least 95% identity to said V region.

In embodiments of the immediately preceding embodiment of the invention, the first and second domains are each an Fc domain of an IgG antibody.

In embodiments of the immediately preceding embodiment of the invention, the first and second domains each comprise one or more mutations that reduce Fc gamma receptor binding activity.

In embodiments of the immediately preceding embodiment of the invention, the one or more mutations that reduce Fc gamma receptor binding activity are selected from:

a) P329G/L234A/L235A (PGLALA),
b) L234A/L235A (LALA),
c) P331S/L234A/L235A,
d) L234F/L235E/P331S, and
e) L234F/L235E/P329G.

In embodiments of the invention:

a) the first and second domains are each a wild-type Fc domain, the third and fourth domains each comprise the V region of a Fab domain of Adalimumab or a variant thereof with at least 90%, preferably at least 95% identity to said V region, and the fifth and sixth domains each comprise the V region of a Fab domain of Ustekinumab or a variant thereof with at least 90%, preferably at least 95% identity to said V region;

b) the first and second domains each comprise L234A and L235A mutations, the third and fourth domains each comprise the V region of a Fab domain of Adalimumab or a variant thereof with at least 90%, preferably at least 95% identity to said V region, and the fifth and sixth domains each comprise the V region of a Fab domain of Ustekinumab or a variant thereof with at least 90%, preferably at least 95% identity to said V region;

c) the first and second domains are each a wild-type Fc domain, the third and fourth domains each comprise the V region of a Fab domain of Ustekinumab or a variant thereof with at least 90%, preferably at least 95% identity to said V region, and the fifth and sixth domains each comprise the V region of a Fab domain of Adalimumab or a variant thereof with at least 90%, preferably at least 95% identity to said V region;

d) the first and second domains each comprise L234A and L235A mutations, the third and fourth domains each comprise the V region of a Fab domain of Ustekinumab or a variant thereof with at least 90%, preferably at least 95% identity to said V region, and the fifth and sixth domains each comprise the V region of a Fab domain of Adalimumab or a variant thereof with at least 90%, preferably at least 95% identity to said V region;

e) the first and second domains are each a wild-type Fc domain, the third and fourth domains each comprise the V region of a Fab domain of Adalimumab or a variant thereof with at least 90%, preferably at least 95% identity to said V region, and the fifth and sixth domains each comprise the V region of a Fab domain of Secukinumab or a variant thereof with at least 90%, preferably at least 95% identity to said V region;

f) the first and second domains each comprise L234A and L235A mutations, the third and fourth domains each comprise the V region of a Fab domain of Adalimumab or a variant thereof with at least 90%, preferably at least 95% identity to said V region, and the fifth and sixth domains each comprise the V region of a Fab domain of Secukinumab or a variant thereof with at least 90%, preferably at least 95% identity to said V region;

g) the first and second domains are each a wild-type Fc domain, the third and fourth domains each comprise the V region of a Fab domain of Secukinumab or a variant thereof with at least 90%, preferably at least 95% identity to said V region, and the fifth and sixth domains each comprise the V region of a Fab domain of Adalimumab or a variant thereof with at least 90%, preferably at least 95% identity to said V region;

h) the first and second domains each comprise L234A and L235A mutations, the third and fourth domains each comprise the V region of a Fab domain of Secukinumab or a variant thereof with at least 90%, preferably at least 95% identity to said V region, and the fifth and sixth domains each comprise the V region of a Fab domain of Adalimumab or a variant thereof with at least 90%, preferably at least 95% identity to said V region;

i) the first and second domains are each a wild-type Fc domain, the third and fourth domains each comprise the V region of a Fab domain of Ustekinumab or a variant thereof with at least 90%, preferably at least 95% identity to said V region, and the fifth and sixth domains each comprise the V region of a Fab domain of Secukinumab or a variant thereof with at least 90%, preferably at least 95% identity to said V region;

j) the first and second domains each comprise L234A and L235A mutations, the third and fourth domains each comprise the V region of a Fab domain of Ustekinumab or a variant thereof with at least 90%, preferably at least 95% identity to said V region, and the fifth and sixth domains each comprise the V region of a Fab domain of Secukinumab or a variant thereof with at least 90%, preferably at least 95% identity to said V region;

k) the first and second domains are each a wild-type Fc domain, the third and fourth domains each comprise the V region of a Fab domain of Secukinumab or a variant thereof with at least 90%, preferably at least 95% identity to said V region, and the fifth and sixth domains each comprise the V region of a Fab domain of Ustekinumab or a variant thereof with at least 90%, preferably at least 95% identity to said V region;

l) the first and second domains each comprise L234A and L235A mutations, the third and fourth domains each comprise the V region of a Fab domain of Secukinumab or a variant thereof with at least 90%, preferably at least 95% identity to said V region, and the fifth and sixth domains each comprise the V region of a Fab domain of Ustekinumab or a variant thereof with at least 90%, preferably at least 95% identity to said V region;

m) the first and second domains are each a wild-type Fc domain, the third and fourth domains each comprise the V region of a Fab domain of Adalimumab or a variant thereof with at least 90%, preferably at least 95% identity to said V region, and the fifth and sixth domains each comprise the V region of a Fab domain of Vedolizumab or a variant thereof with at least 90%, preferably at least 95% identity to said V region;

n) the first and second domains each comprise L234A and L235A mutations, the third and fourth domains each comprise the V region of a Fab domain of Adalimumab or a variant thereof with at least 90%, preferably at least 95% identity to said V region, and the fifth and sixth domains each comprise the V region of a Fab domain of Vedolizumab or a variant thereof with at least 90%, preferably at least 95% identity to said V region;

o) the first and second domains are each a wild-type Fc domain, the third and fourth domains each comprise the V region of a Fab domain of Vedolizumab or a variant thereof with at least 90%, preferably at least 95% identity to said V region, and the fifth and sixth domains each comprise the V region of a Fab domain of Adalimumab or a variant thereof with at least 90%, preferably at least 95% identity to said V region; or p) the first and second domains each comprise L234A and L235A mutations, the third and fourth domains each comprise the V region of a Fab domain of Vedolizumab or a variant thereof with at least 90%, preferably at least 95% identity to said V region, and the fifth and sixth domains each comprise the V region of a Fab domain of Adalimumab or a variant thereof with at least 90%, preferably at least 95% identity to said V region.

In embodiments of the invention:

a) the V region of a Fab domain of Adalimumab comprises the amino acid sequence set forth in SEQ ID NO:5169 in a first polypeptide chain and the amino acid sequence set forth in SEQ ID NO:5173 in a second polypeptide chain;

b) the V region of a Fab domain of Secukinumab comprises the amino acid sequence set forth in SEQ ID NO:

7157 in a first polypeptide chain and the amino acid sequence set forth in SEQ ID NO: 7261 in a second polypeptide chain;

c) the V region of a Fab domain of Ustekinumab comprises the amino acid sequence set forth in SEQ ID NO:7645 in a first polypeptide chain and the amino acid sequence set forth in SEQ ID NO:7649 in a second polypeptide chain; and d) the V region of a Fab domain of Vedolizumab comprises the amino acid sequence set forth in SEQ ID NO:7685 in a first polypeptide chain and the amino acid sequence set forth in SEQ ID NO: 7689 in a second polypeptide chain.

In embodiments of the immediately preceding embodiment of the invention:

a) if the third, fourth, fifth or sixth domain comprises the V region of a Fab domain of Adalimumab or a variant thereof with at least 90% or at least 95% identity to said V region, said domain comprises complementarity determining region (CDR) sequences set forth in SEQ ID NOs: 5170-5172 in a first polypeptide chain of the domain and complementarity determining region (CDR) sequences set forth in SEQ ID NOs: 5174-5176 in a second polypeptide chain of the domain;

b) if the third, fourth, fifth or sixth domain comprises the V region of a Fab domain of Secukinumab or a variant thereof with at least 90% or at least 95% identity to said V region, said domain comprises complementarity determining region (CDR) sequences set forth in SEQ ID NOs: 7258-7260 in a first polypeptide chain of the domain and complementarity determining region (CDR) sequences set forth in SEQ ID NOs: 7262-7264 in a second polypeptide chain of the domain;

c) if the third, fourth, fifth or sixth domain comprises the V region of a Fab domain of Ustekinumab or a variant thereof with at least 90% or at least 95% identity to said V region, said domain comprises complementarity determining region (CDR) sequences set forth in SEQ ID NOs: 7646-7648 in a first polypeptide chain of the domain and complementarity determining region (CDR) sequences set forth in SEQ ID NOs: 7650-7652 in a second polypeptide chain of the domain; and d) if the third, fourth, fifth or sixth domain comprises the V region of a Fab domain of Vedolizumab or a variant thereof with at least 90% or at least 95% identity to said V region, said domain comprises complementarity determining region (CDR) sequences set forth in SEQ ID NOs: 7686-7688 in a first polypeptide chain of the domain and complementarity determining region (CDR) sequences set forth in SEQ ID NOs: 7690-7692 in a second polypeptide chain of the domain.

In embodiments of the invention:

a) if the third, fourth, fifth or sixth domain comprises the V region of a Fab domain of Adalimumab or a variant thereof with at least 90% or at least 95% identity to said V region, said domain comprises complementarity determining region (CDR) sequences set forth in SEQ ID NOs: 5170-5172 in a first polypeptide chain of the domain and complementarity determining region (CDR) sequences set forth in SEQ ID NOs: 5174-5176 in a second polypeptide chain of the domain;

b) if the third, fourth, fifth or sixth domain comprises the V region of a Fab domain of Secukinumab or a variant thereof with at least 90% or at least 95% identity to said V region, said domain comprises complementarity determining region (CDR) sequences set forth in SEQ ID NOs: 7258-7260 in a first polypeptide chain of the domain and complementarity determining region (CDR) sequences set forth in SEQ ID NOs: 7262-7264 in a second polypeptide chain of the domain;

c) if the third, fourth, fifth or sixth domain comprises the V region of a Fab domain of Ustekinumab or a variant thereof with at least 90% or at least 95% identity to said V region, said domain comprises complementarity determining region (CDR) sequences set forth in SEQ ID NOs: 7646-7648 in a first polypeptide chain of the domain and complementarity determining region (CDR) sequences set forth in SEQ ID NOs: 7650-7652 in a second polypeptide chain of the domain; and d) if the third, fourth, fifth or sixth domain comprises the V region of a Fab domain of Vedolizumab or a variant thereof with at least 90% or at least 95% identity to said V region, said domain comprises complementarity determining region (CDR) sequences set forth in SEQ ID NOs: 7686-7688 in a first polypeptide chain of the domain and complementarity determining region (CDR) sequences set forth in SEQ ID NOs: 7690-7692 in a second polypeptide chain of the domain.

In embodiments of the invention, the tetrahedral antibody is formed by four different types of polypeptide chains denoted L1, H1, L2, and H2, wherein:

a) the C-terminal portion of the H1 and H2 chains pair with one another to form each of the first and second domains, b) the N-terminal portion of the H1 chain pairs with the L1 chains to form each of the third and fourth domains, c) the N-terminal portion of the H2 chain pairs with the L2 chains to form each of the fifth and sixth domains, and d) the H1 chain contains the collectrin-like domain polypeptide between the portion of the H1 chain that pairs with the H2 chain and the portion that pairs with the L1 chain.

In embodiments of the immediately preceding embodiment of the invention:

a) the H1 chain comprises the amino acid sequence set forth in SEQ ID NO: 4866, the H2 chain comprises the amino acid sequence set forth in SEQ ID NO: 4867, the L1 chain comprises the amino acid sequence set forth in SEQ ID NO: 4894, and the L2 chain comprises the amino acid sequence set forth in SEQ ID NO: 4895;

b) the H1 chain comprises the amino acid sequence set forth in SEQ ID NO: 4866, the H2 chain comprises the amino acid sequence set forth in SEQ ID NO: 4868, the L1 chain comprises the amino acid sequence set forth in SEQ ID NO: 4894, and the L2 chain comprises the amino acid sequence set forth in SEQ ID NO: 4896;

c) the H1 chain comprises the amino acid sequence set forth in SEQ ID NO: 4869, the H2 chain comprises the amino acid sequence set forth in SEQ ID NO: 4867, the L1 chain comprises the amino acid sequence set forth in SEQ ID NO: 4897, and the L2 chain comprises the amino acid sequence set forth in SEQ ID NO: 4895;

d) the H1 chain comprises the amino acid sequence set forth in SEQ ID NO: 4869, the H2 chain comprises the amino acid sequence set forth in SEQ ID NO: 4868, the L1 chain comprises the amino acid sequence set forth in SEQ ID NO: 4897, and the L2 chain comprises the amino acid sequence set forth in SEQ ID NO: 4896;

e) the H1 chain comprises the amino acid sequence set forth in SEQ ID NO: 4870, the H2 chain comprises the amino acid sequence set forth in SEQ ID NO: 4871, the L1 chain comprises the amino acid sequence set forth in SEQ ID NO: 4898, and the L2 chain comprises the amino acid sequence set forth in SEQ ID NO: 4899;

f) the H1 chain comprises the amino acid sequence set forth in SEQ ID NO: 4870, the H2 chain comprises the amino acid sequence set forth in SEQ ID NO: 4872, the L1 chain comprises the amino acid sequence set forth in SEQ ID NO: 4898, and the L2 chain comprises the amino acid sequence set forth in SEQ ID NO: 4900;

g) the H1 chain comprises the amino acid sequence set forth in SEQ ID NO: 4873, the H2 chain comprises the amino acid sequence set forth in SEQ ID NO: 4871, the L1 chain comprises the amino acid sequence set forth in SEQ ID NO: 4901, and the L2 chain comprises the amino acid sequence set forth in SEQ ID NO: 4899;

h) the H1 chain comprises the amino acid sequence set forth in SEQ ID NO: 4873, the H2 chain comprises the amino acid sequence set forth in SEQ ID NO: 4872, the L1 chain comprises the amino acid sequence set forth in SEQ ID NO: 4901, and the L2 chain comprises the amino acid sequence set forth in SEQ ID NO: 4900;

i) the H1 chain comprises the amino acid sequence set forth in SEQ ID NO: 4866, the H2 chain comprises the amino acid sequence set forth in SEQ ID NO: 4874, the L1 chain comprises the amino acid sequence set forth in SEQ ID NO: 4894, and the L2 chain comprises the amino acid sequence set forth in SEQ ID NO: 4902;

j) the H1 chain comprises the amino acid sequence set forth in SEQ ID NO: 4866, the H2 chain comprises the amino acid sequence set forth in SEQ ID NO: 4875, the L1 chain comprises the amino acid sequence set forth in SEQ ID NO: 4894, and the L2 chain comprises the amino acid sequence set forth in SEQ ID NO: 4903;

k) the H1 chain comprises the amino acid sequence set forth in SEQ ID NO: 4869, the H2 chain comprises the amino acid sequence set forth in SEQ ID NO: 4874, the L1 chain comprises the amino acid sequence set forth in SEQ ID NO: 4897, and the L2 chain comprises the amino acid sequence set forth in SEQ ID NO: 4902;

l) the H1 chain comprises the amino acid sequence set forth in SEQ ID NO: 4869, the H2 chain comprises the amino acid sequence set forth in SEQ ID NO: 4875, the L1 chain comprises the amino acid sequence set forth in SEQ ID NO: 4897, and the L2 chain comprises the amino acid sequence set forth in SEQ ID NO: 4903;

m) the H1 chain comprises the amino acid sequence set forth in SEQ ID NO: 4876, the H2 chain comprises the amino acid sequence set forth in SEQ ID NO: 4871, the L1 chain comprises the amino acid sequence set forth in SEQ ID NO: 4904, and the L2 chain comprises the amino acid sequence set forth in SEQ ID NO: 4899;

n) the H1 chain comprises the amino acid sequence set forth in SEQ ID NO: 4876, the H2 chain comprises the amino acid sequence set forth in SEQ ID NO: 4872, the L1 chain comprises the amino acid sequence set forth in SEQ ID NO: 4904, and the L2 chain comprises the amino acid sequence set forth in SEQ ID NO: 4900;

o) the H1 chain comprises the amino acid sequence set forth in SEQ ID NO: 4877, the H2 chain comprises the amino acid sequence set forth in SEQ ID NO: 4871, the L1 chain comprises the amino acid sequence set forth in SEQ ID NO: 4905, and the L2 chain comprises the amino acid sequence set forth in SEQ ID NO: 4899;

p) the H1 chain comprises the amino acid sequence set forth in SEQ ID NO: 4877, the H2 chain comprises the amino acid sequence set forth in SEQ ID NO: 4872, the L1 chain comprises the amino acid sequence set forth in SEQ ID NO: 4905, and the L2 chain comprises the amino acid sequence set forth in SEQ ID NO: 4900;

q) the H1 chain comprises the amino acid sequence set forth in SEQ ID NO: 4870, the H2 chain comprises the amino acid sequence set forth in SEQ ID NO: 4874, the L1 chain comprises the amino acid sequence set forth in SEQ ID NO: 4898, and the L2 chain comprises the amino acid sequence set forth in SEQ ID NO: 4902;

r) the H1 chain comprises the amino acid sequence set forth in SEQ ID NO: 4870, the H2 chain comprises the amino acid sequence set forth in SEQ ID NO: 4875, the L1 chain comprises the amino acid sequence set forth in SEQ ID NO: 4898, and the L2 chain comprises the amino acid sequence set forth in SEQ ID NO: 4903;

s) the H1 chain comprises the amino acid sequence set forth in SEQ ID NO: 4873, the H2 chain comprises the amino acid sequence set forth in SEQ ID NO: 4874, the L1 chain comprises the amino acid sequence set forth in SEQ ID NO: 4901, and the L2 chain comprises the amino acid sequence set forth in SEQ ID NO: 4902;

t) the H1 chain comprises the amino acid sequence set forth in SEQ ID NO: 4873, the H2 chain comprises the amino acid sequence set forth in SEQ ID NO: 4875, the L1 chain comprises the amino acid sequence set forth in SEQ ID NO: 4901, and the L2 chain comprises the amino acid sequence set forth in SEQ ID NO: 4903;

u) the H1 chain comprises the amino acid sequence set forth in SEQ ID NO: 4876, the H2 chain comprises the amino acid sequence set forth in SEQ ID NO: 4867, the L1 chain comprises the amino acid sequence set forth in SEQ ID NO: 4904, and the L2 chain comprises the amino acid sequence set forth in SEQ ID NO: 4895;

v) the H1 chain comprises the amino acid sequence set forth in SEQ ID NO: 4876, the H2 chain comprises the amino acid sequence set forth in SEQ ID NO: 4868, the L1 chain comprises the amino acid sequence set forth in SEQ ID NO: 4904, and the L2 chain comprises the amino acid sequence set forth in SEQ ID NO: 4896;

w) the H1 chain comprises the amino acid sequence set forth in SEQ ID NO: 4877, the H2 chain comprises the amino acid sequence set forth in SEQ ID NO: 4867, the L1 chain comprises the amino acid sequence set forth in SEQ ID NO: 4905, and the L2 chain comprises the amino acid sequence set forth in SEQ ID NO: 4895;

x) the H1 chain comprises the amino acid sequence set forth in SEQ ID NO: 4877, the H2 chain comprises the amino acid sequence set forth in SEQ ID NO: 4868, the L1 chain comprises the amino acid sequence set forth in SEQ ID NO: 4905, and the L2 chain comprises the amino acid sequence set forth in SEQ ID NO: 4896;

y) the H1 chain comprises the amino acid sequence set forth in SEQ ID NO: 4878, the H2 chain comprises the amino acid sequence set forth in SEQ ID NO: 4879, the L1 chain comprises the amino acid sequence set forth in SEQ ID NO: 4894, and the L2 chain comprises the amino acid sequence set forth in SEQ ID NO: 4906;

z) the H1 chain comprises the amino acid sequence set forth in SEQ ID NO: 4878, the H2 chain comprises the amino acid sequence set forth in SEQ ID NO: 4880, the L1 chain comprises the amino acid sequence set forth in SEQ ID NO: 4894, and the L2 chain comprises the amino acid sequence set forth in SEQ ID NO: 4907;

aa) the H1 chain comprises the amino acid sequence set forth in SEQ ID NO: 4881, the H2 chain comprises the amino acid sequence set forth in SEQ ID NO: 4879, the L1 chain comprises the amino acid sequence set forth in SEQ ID NO: 4897, and the L2 chain comprises the amino acid sequence set forth in SEQ ID NO: 4906;

bb) the H1 chain comprises the amino acid sequence set forth in SEQ ID NO: 4881, the H2 chain comprises the amino acid sequence set forth in SEQ ID NO: 4880, the L1 chain comprises the amino acid sequence set forth in SEQ ID NO: 4897, and the L2 chain comprises the amino acid sequence set forth in SEQ ID NO: 4907;

cc) the H1 chain comprises the amino acid sequence set forth in SEQ ID NO: 4882, the H2 chain comprises the amino acid sequence set forth in SEQ ID NO: 4883, the L1 chain comprises the amino acid sequence set forth in SEQ ID NO: 4908, and the L2 chain comprises the amino acid sequence set forth in SEQ ID NO: 4899;

dd) the H1 chain comprises the amino acid sequence set forth in SEQ ID NO: 4882, the H2 chain comprises the amino acid sequence set forth in SEQ ID NO: 4884, the L1 chain comprises the amino acid sequence set forth in SEQ ID NO: 4908, and the L2 chain comprises the amino acid sequence set forth in SEQ ID NO: 4900;

ee) the H1 chain comprises the amino acid sequence set forth in SEQ ID NO: 4885, the H2 chain comprises the amino acid sequence set forth in SEQ ID NO: 4883, the L1 chain comprises the amino acid sequence set forth in SEQ ID NO: 4909, and the L2 chain comprises the amino acid sequence set forth in SEQ ID NO: 4899; or ff) the H1 chain comprises the amino acid sequence set forth in SEQ ID NO: 4885, the H2 chain comprises the amino acid sequence set forth in SEQ ID NO: 4884, the L1 chain comprises the amino acid sequence set forth in SEQ ID NO: 4909, and the L2 chain comprises the amino acid sequence set forth in SEQ ID NO: 4900; or gg) the L1, H1, L2, and H2 chains are variants with at least 90%, preferably at least 95%, more preferably at least 98% identity to said sequences.

This invention also provides a tetrahedral antibody comprising a first, second, third, and fourth, fifth, and sixth domain, wherein:

a) each of the first and second domains are an Fc domain and comprise:
   i) a first polypeptide chain comprising a first N-terminus and a first C-terminus of the domain, and
   ii) a second polypeptide chain comprising a second N-terminus and a second C-terminus of the domain, b) either:
   i) the third and fourth domains are Fab domains, and the fifth, and sixth domains are the extracellular domain of a transmembrane protein, or
   ii) the third and fourth domains are the extracellular domain of a transmembrane protein, and the fifth, and sixth domains are Fab domains, c) the first domain and the second domain are joined to each other by a non-covalent linkage between a first collectrin-like domain polypeptide attached by a peptide bond or via a peptide linker to the first N-terminus of the first domain, and a second collectrin-like domain polypeptide attached by a peptide bond or via a peptide linker to the first N-terminus of the second domain;

d) the third domain is attached at its C-terminus by a peptide bond or via a peptide linker to the N-terminus of the first collectrin-like domain polypeptide, e) the fourth domain is attached at its C-terminus by a peptide bond or via a peptide linker to the N-terminus of the second collectrin-like domain polypeptide, f) the fifth domain is attached at its C-terminus by a peptide bond or via a peptide linker to the second N-terminus of the first domain, g) the sixth domain is attached at its C-terminus by a peptide bond or via a peptide linker to the second N-terminus of the second domain.

In embodiments of the immediately preceding embodiment of the invention, the first and second domains are each an Fc domain of an IgG antibody.

In embodiments of the immediately preceding embodiment of the invention, the first and second domains each comprise one or more mutations that reduce Fc gamma receptor binding activity.

In embodiments of the immediately preceding embodiment of the invention, the one or more mutations that reduce Fc gamma receptor binding activity are selected from:

a) P329G/L234A/L235A (PGLALA),
b) L234A/L235A (LALA),
c) P331S/L234A/L235A,
d) L234F/L235E/P331S, and
e) L234F/L235E/P329G.

In embodiments of the invention:

a) the fifth and sixth domains comprise the extracellular domain of a TNFR1B receptor; and b) the third and fourth domains are Fab domains comprising the V region of a Fab domain of Adalimumab, Ustekinumab, Secukinumab, Vedolizumab or a variant thereof with at least 90%, preferably at least 95% identity to said V region.

In embodiments of the invention:

a) the third and fourth domains comprise the extracellular domain of a TNFR1B receptor; and b) the fifth and sixth domains are Fab domains comprising the V region of a Fab domain of Adalimumab, Ustekinumab, Secukinumab, Vedolizumab or a variant thereof with at least 90%, preferably at least 95% identity to said V region.

In embodiments of the immediately preceding embodiment of the invention, the first and second domains each comprise one or more mutations that reduce Fc gamma receptor binding activity.

In embodiments of the immediately preceding embodiment of the invention, the one or more mutations that reduce Fc gamma receptor binding activity are selected from:

a) P329G/L234A/L235A (PGLALA),
b) L234A/L235A (LALA),
c) P331S/L234A/L235A,
d) L234F/L235E/P331S, and
e) L234F/L235E/P329G.

In embodiments of the immediately preceding embodiment of the invention, the extracellular domain of a TNFR1B receptor comprises the amino acid sequence set forth in SEQ ID NO: 1989.

In embodiments of the invention, the extracellular domain of a TNFR1B receptor comprises the amino acid sequence set forth in SEQ ID NO: 1989.

In embodiments of the invention:

a) the extracellular domain of a TNFR1B receptor comprises the amino acid sequence set forth in SEQ ID NO: 1989;

b) the V region of a Fab domain of Adalimumab comprises the amino acid sequence set forth in SEQ ID NO:5169 in a first polypeptide chain and the amino acid sequence set forth in SEQ ID NO:5173 in a second polypeptide chain;

c) the V region of a Fab domain of Secukinumab comprises the amino acid sequence set forth in SEQ ID NO: 7157 in a first polypeptide chain and the amino acid sequence set forth in SEQ ID NO: 7261 in a second polypeptide chain;

d) the V region of a Fab domain of Ustekinumab comprises the amino acid sequence set forth in SEQ ID NO:7645 in a first polypeptide chain and the amino acid sequence set forth in SEQ ID NO:7649 in a second polypeptide chain; and e) the V region of a Fab domain of Vedolizumab comprises the amino acid sequence set forth in SEQ ID NO:7685 in a first polypeptide chain and the amino acid sequence set forth in SEQ ID NO: 7689 in a second polypeptide chain.

In embodiments of the invention:

a) if the fifth or sixth domain comprises the V region of a Fab domain of Adalimumab or a variant thereof with at least 90% or at least 95% identity to said V region, said domain comprises complementarity determining region (CDR) sequences set forth in SEQ ID NOs: 5170-5172 in a first polypeptide chain of the domain and complementarity determining region (CDR) sequences set forth in SEQ ID NOs: 5174-5176 in a second polypeptide chain of the domain;

b) if the fifth or sixth domain comprises the V region of a Fab domain of Secukinumab or a variant thereof with at least 90% or at least 95% identity to said V region, said domain comprises complementarity determining region (CDR) sequences set forth in SEQ ID NOs: 7258-7260 in a first polypeptide chain of the domain and complementarity determining region (CDR) sequences set forth in SEQ ID NOs: 7262-7264 in a second polypeptide chain of the domain;

c) if the fifth or sixth domain comprises the V region of a Fab domain of Ustekinumab or a variant thereof with at least 90% or at least 95% identity to said V region, said domain comprises complementarity determining region (CDR) sequences set forth in SEQ ID NOs: 7646-7648 in a first polypeptide chain of the domain and complementarity determining region (CDR) sequences set forth in SEQ ID NOs: 7650-7652 in a second polypeptide chain of the domain; and d) if the fifth or sixth domain comprises the V region of a Fab domain of Vedolizumab or a variant thereof with at least 90% or at least 95% identity to said V region, said domain comprises complementarity determining region (CDR) sequences set forth in SEQ ID NOs: 7686-7688 in a first polypeptide chain of the domain and complementarity determining region (CDR) sequences set forth in SEQ ID NOs: 7690-7692 in a second polypeptide chain of the domain.

In embodiments of the immediately preceding embodiment of the invention, the extracellular domain of a TNFR1B receptor comprises the amino acid sequence set forth in SEQ ID NO: 1989.

In embodiments of the invention:

a) the third and fourth domains comprise the extracellular domain of a TNFR1B receptor and the fifth and sixth domains are Fab domains comprising the V region of a Fab domain of Adalimumab or a variant thereof with at least 90%, preferably at least 95% identity to said V region;

b) the third and fourth domains comprise the extracellular domain of a TNFR1B receptor and the fifth and sixth domains are Fab domains comprising the V region of a Fab domain of Ustekinumab or a variant thereof with at least 90%, preferably at least 95% identity to said V region;

c) the third and fourth domains comprise the extracellular domain of a TNFR1B receptor and the fifth and sixth domains are Fab domains comprising the V region of a Fab domain of Secukinumab or a variant thereof with at least 90%, preferably at least 95% identity to said V region; or d) the third and fourth domains comprise the extracellular domain of a TNFR1B receptor and the fifth and sixth domains are Fab domains comprising the V region of a Fab domain of Vedolizumab or a variant thereof with at least 90%, preferably at least 95% identity to said V region.

In embodiments of the immediately preceding embodiment of the invention:

a) the extracellular domain of a TNFR1B receptor comprises the amino acid sequence set forth in SEQ ID NO: 1989;

b) the V region of a Fab domain of Adalimumab comprises the amino acid sequence set forth in SEQ ID NO:5169 in a first polypeptide chain and the amino acid sequence set forth in SEQ ID NO:5173 in a second polypeptide chain;

c) the V region of a Fab domain of Secukinumab comprises the amino acid sequence set forth in SEQ ID NO: 7157 in a first polypeptide chain and the amino acid sequence set forth in SEQ ID NO: 7261 in a second polypeptide chain;

d) the V region of a Fab domain of Ustekinumab comprises the amino acid sequence set forth in SEQ ID NO:7645 in a first polypeptide chain and the amino acid sequence set forth in SEQ ID NO:7649 in a second polypeptide chain; and e) the V region of a Fab domain of Vedolizumab comprises the amino acid sequence set forth in SEQ ID NO:7685 in a first polypeptide chain and the amino acid sequence set forth in SEQ ID NO: 7689 in a second polypeptide chain.

In embodiments of the immediately preceding embodiment of the invention:

a) if the fifth or sixth domain comprises the V region of a Fab domain of Adalimumab or a variant thereof with at least 90% or at least 95% identity to said V region, said domain comprises complementarity determining region (CDR) sequences set forth in SEQ ID NOs: 5170-5172 in a first polypeptide chain of the domain and complementarity determining region (CDR) sequences set forth in SEQ ID NOs: 5174-5176 in a second polypeptide chain of the domain;

b) if the fifth or sixth domain comprises the V region of a Fab domain of Secukinumab or a variant thereof with at least 90% or at least 95% identity to said V region, said domain comprises complementarity determining region (CDR) sequences set forth in SEQ ID NOs: 7258-7260 in a first polypeptide chain of the domain and complementarity determining region (CDR) sequences set forth in SEQ ID NOs: 7262-7264 in a second polypeptide chain of the domain;

c) if the fifth or sixth domain comprises the V region of a Fab domain of Ustekinumab or a variant thereof with at least 90% or at least 95% identity to said V region, said domain comprises complementarity determining region (CDR) sequences set forth in SEQ ID NOs: 7646-7648 in a first polypeptide chain of the domain and complementarity determining region (CDR) sequences set forth in SEQ ID NOs: 7650-7652 in a second polypeptide chain of the domain; and d) if the fifth or sixth domain comprises the V region of a Fab domain of Vedolizumab or a variant thereof with at least 90% or at least 95% identity to said V region, said domain comprises complementarity determining region (CDR) sequences set forth in SEQ ID NOs: 7686-7688 in a first polypeptide chain of the domain and complementarity determining region (CDR) sequences set forth in SEQ ID NOs: 7690-7692 in a second polypeptide chain of the domain.

In embodiments of the invention:

a) if the fifth or sixth domain comprises the V region of a Fab domain of Adalimumab or a variant thereof with at least 90% or at least 95% identity to said V region, said domain comprises complementarity determining region (CDR) sequences set forth in SEQ ID NOs: 5170-5172 in a first polypeptide chain of the domain and complementarity determining region (CDR) sequences set forth in SEQ ID NOs: 5174-5176 in a second polypeptide chain of the domain;

b) if the fifth or sixth domain comprises the V region of a Fab domain of Secukinumab or a variant thereof with at least 90% or at least 95% identity to said V region, said domain comprises complementarity determining region (CDR) sequences set forth in SEQ ID NOs: 7258-7260 in a first polypeptide chain of the domain and complementarity determining region (CDR) sequences set forth in SEQ ID NOs: 7262-7264 in a second polypeptide chain of the domain;

c) if the fifth or sixth domain comprises the V region of a Fab domain of Ustekinumab or a variant thereof with at least 90% or at least 95% identity to said V region, said domain comprises complementarity determining region (CDR) sequences set forth in SEQ ID NOs: 7646-7648 in a first polypeptide chain of the domain and complementarity determining region (CDR) sequences set forth in SEQ ID NOs: 7650-7652 in a second polypeptide chain of the domain; and d) if the fifth or sixth domain comprises the V region of a Fab domain of Vedolizumab or a variant thereof with at least 90% or at least 95% identity to said V region, said domain comprises complementarity determining region (CDR) sequences set forth in SEQ ID NOs: 7686-7688 in a first polypeptide chain of the domain and complementarity determining region (CDR) sequences set forth in SEQ ID NOs: 7690-7692 in a second polypeptide chain of the domain.

In embodiments of the invention, the tetrahedral antibody is formed by three different types of polypeptide chains denoted H1, L1, and Fc wherein:

a) the C-terminal portion of the H1 chain pair the Fc chain to form each of the first and second domains, b) the N-terminal portion the H1 chain pairs with the L1 chains to form each of the third and fourth domains, c) the N-terminal portion of the Fc chain forms each of the fifth and sixth domains, and d) the H1 chain contains the collectrin-like domain polypeptide between the portion of the H1 chain that pairs with the Fc chain and the portion that pairs with the L1 chain.

In embodiments of the immediately preceding embodiment of the invention:

a) the H1 chain comprises the amino acid sequence set forth in SEQ ID NO:4886, the L1 chain comprises the amino acid sequence set forth in SEQ ID NO: 4910, and the Fc chain comprises the amino acid sequence set forth in SEQ ID NO: 4918;

b) the H1 chain comprises the amino acid sequence set forth in SEQ ID NO:4887, the L1 chain comprises the amino acid sequence set forth in SEQ ID NO: 4911, and the Fc chain comprises the amino acid sequence set forth in SEQ ID NO: 4918;

c) the H1 chain comprises the amino acid sequence set forth in SEQ ID NO:4888, the L1 chain comprises the amino acid sequence set forth in SEQ ID NO: 4912, and the Fc chain comprises the amino acid sequence set forth in SEQ ID NO: 4918;

d) the H1 chain comprises the amino acid sequence set forth in SEQ ID NO:4889, the L1 chain comprises the amino acid sequence set forth in SEQ ID NO: 4913, and the Fc chain comprises the amino acid sequence set forth in SEQ ID NO: 4918;

e) the H1 chain comprises the amino acid sequence set forth in SEQ ID NO:4890, the L1 chain comprises the amino acid sequence set forth in SEQ ID NO: 4914, and the Fc chain comprises the amino acid sequence set forth in SEQ ID NO: 4918;

f) the H1 chain comprises the amino acid sequence set forth in SEQ ID NO:4891, the L1 chain comprises the amino acid sequence set forth in SEQ ID NO: 4915, and the Fc chain comprises the amino acid sequence set forth in SEQ ID NO: 4918;

g the H1 chain comprises the amino acid sequence set forth in SEQ ID NO:4892, the L1 chain comprises the amino acid sequence set forth in SEQ ID NO: 4916, and the Fc chain comprises the amino acid sequence set forth in SEQ ID NO: 4919; or h) the H1 chain comprises the amino acid sequence set forth in SEQ ID NO:4893, the L1 chain comprises the amino acid sequence set forth in SEQ ID NO: 4917, and the Fc chain comprises the amino acid sequence set forth in SEQ ID NO: 4919.

Vectors

This invention provides one or more vectors comprising polynucleotides which encode polypeptides comprising four different polypeptide chains from any of teh groups listed above, wherein each polynucleotide is operably linked to a promoter which directs expression of the polynucleotide in a host cell.

Host Cells

This invention provides a host cell comprising any of the one or more vectors described above.

Method of Producing

This invention provides a method of producing a tetrahedral antibody, the method comprising recombinantly expressing four different polypeptide chains from any of teh groups listed above in a host cell.

Pharmaceutical Compositions

This invention provides a pharmaceutical composition comprising any one of the tetrahedral antibodies listed above and one or more pharmaceutically acceptable excipients.

Methods of Treating

This invention provides a method of treating cancer in a subject, the method comprising administering to the subject a therapeutically effective amount of a pharmaceutical composition of the invention, preferably wherein the cancer is B cell cancer.

This invention provides a method of treating inflammatory disease in a subject, the method comprising administering to the subject a therapeutically effective amount of the pharmaceutical composition of the invention.

Tetrahedral Antibodies

This invention provides a tetrahedral antibody comprising a first, second, third, and fourth domain, wherein:

a) each of the first and second domains are selected from the group consisting of a Fab domain and an Fc domain, b) each of the first and second domains comprise:
 i) a first polypeptide chain comprising a first N-terminus and a first C-terminus of the domain, and
 ii) a second polypeptide chain comprising a second N-terminus and a second C-terminus of the domain,
c) the first domain and the second domain are joined to each other by a non-peptidyl linkage wherein the non-peptidyl linkage is:
 i) a covalent linkage
  (1) attached to the first N-terminus of the first domain and the first N-terminus of the second domain,
  (2) attached to the first C-terminus of the first domain and the first C-terminus of the second domain,
  (3) attached to the first N-terminus of the first domain and the first C-terminus of the second domain, or
  (4) attached to the first C-terminus of the first domain and the first N-terminus of the second domain, or
 ii) a non-covalent linkage
  (1) between a first dimerizing polypeptide attached by a peptide bond or via a peptide linker to the first N-terminus of the first domain, and a second dimerizing polypeptide attached by a peptide bond or via a peptide linker to the first N-terminus of the second domain,
  (2) between a first dimerizing polypeptide attached by a peptide bond or via a peptide linker to the first C-terminus of the first domain, and a second dimerizing polypeptide attached by a peptide bond or via a peptide linker to the first C-terminus of the second domain,
  (3) between a first dimerizing polypeptide attached by a peptide bond or via a peptide linker to the first N-terminus of the first domain, and a second dimerizing polypeptide attached by a peptide bond or via a peptide linker to the first C-terminus of the second domain, or
  (4) between a first dimerizing polypeptide attached by a peptide bond or via a peptide linker to the first C-terminus of the first domain, and a second dimerizing polypeptide attached by a peptide bond or via a peptide linker to the first N-terminus of the second domain,
 wherein the first and second dimerizing polypeptides are not immunoglobulin polypeptides,
d) if the first domain is joined to the second domain via a covalent linkage attached to the first N-terminus of the first domain, then the third domain is attached at its C-terminus to the second N-terminus of the first domain by a peptide bond or via a peptide linker,
e) if the first domain is joined to the second domain via a covalent linkage attached to the first C-terminus of the first domain then the third domain is attached at its N-terminus to the second C-terminus of the first domain by a peptide bond or via a peptide linker,
f) if the first domain is joined to the second domain via a first dimerizing polypeptide attached to the first N-terminus of the first domain, then the third domain is attached at its C-terminus by a peptide bond or via a peptide linker to
 i) the N-terminus of the first dimerizing polypeptide,
 ii) the second N-terminus of the first domain, or
 iii) the N-terminus of a third dimerizing polypeptide, wherein the third dimerizing polypeptide is attached at its C-terminus by a peptide bond or via a peptide linker to the second N-terminus of the first domain,
g) if the first domain is joined to the second domain via a first dimerizing polypeptide attached to the first C-terminus of the first domain, then the third domain is attached at its N-terminus by a peptide bond or via a peptide linker to
 i) the C-terminus of the first dimerizing polypeptide,
 ii) the second C-terminus of the first domain, or
 iii) the C-terminus of a third dimerizing polypeptide, wherein the third dimerizing polypeptide is attached at its N-terminus by a peptide bond or via a peptide linker to the second C-terminus of the first domain,
h) if the second domain is joined to the first domain via a covalent linkage attached to the first N-terminus of the second domain, then the fourth domain is attached at its C-terminus to the second N-terminus of the second domain by a peptide bond or via a peptide linker,
i) if the second domain is joined to the first domain via a covalent linkage attached to the first C-terminus of the second domain then the fourth domain is attached at its N-terminus to the second C-terminus of the second domain by a peptide bond or via a peptide linker,
j) if the second domain is joined to the first domain via a second dimerizing polypeptide attached to the first N-terminus of the second domain, then the fourth domain is attached at its C-terminus by a peptide bond or via a peptide linker to
 i) the N-terminus of the second dimerizing polypeptide,
 ii) the second N-terminus of the second domain, or
 iii) the N-terminus of a fourth dimerizing polypeptide, wherein the third dimerizing polypeptide is attached at its C-terminus by a peptide bond or via a peptide linker to the second N-terminus of the second domain,
k) if the second domain is joined to the first domain via a second dimerizing polypeptide attached to the first C-terminus of the second domain, then the fourth domain is attached at its N-terminus by a peptide bond or via a peptide linker to
 i) the C-terminus of the second dimerizing polypeptide,
 ii) the second C-terminus of the second domain, or
 iii) the C-terminus of a fourth dimerizing polypeptide, wherein the fourth dimerizing polypeptide is attached at its N-terminus by a peptide bond or via a peptide linker to the second C-terminus of the second domain.

In a preferred embodiment, the non-peptidyl linkage is a covalent linkage attached to the first N-terminus of the first domain and the first N-terminus of the second domain. In this preferred embodiment, the third domain is attached at its C-terminus to the second N-terminus of the first domain by a peptide bond or via a peptide linker. Further, in this preferred embodiment, the fourth domain is attached at its C-terminus to the second N-terminus of the second domain by a peptide bond or via a peptide linker.

In a preferred embodiment, the non-peptidyl linkage is a non-covalent linkage between a first dimerizing polypeptide attached by a peptide bond or via a peptide linker to the first N-terminus of the first domain, and a second dimerizing polypeptide attached by a peptide bond or via a peptide linker to the first N-terminus of the second domain. In this preferred embodiment, the third domain is attached at its N-terminus by a peptide bond or via a peptide linker to (a) the C-terminus of the first dimerizing polypeptide, or (b) the second C-terminus of the first domain. Further, in this preferred embodiment, the fourth domain is attached at its C-terminus by a peptide bond or via a peptide linker to (a)

the N-terminus of the second dimerizing polypeptide, or (b) the second N-terminus of the second domain.

In an alternative embodiment, the non-peptidyl linkage is a covalent linkage:

a) attached to the first C-terminus of the first domain and the first C-terminus of the second domain, b) attached to the first C-terminus of the first domain and the first C-terminus of the second domain, or c) attached to the first N-terminus of the first domain and the first C-terminus of the second domain In an alternative embodiment, the non-peptidyl linkage is a non-covalent linkage a) between a first dimerizing polypeptide attached by a peptide bond or via a peptide linker to the first C-terminus of the first domain, and a second dimerizing polypeptide attached by a peptide bond or via a peptide linker to the first C-terminus of the second domain, b) between a first dimerizing polypeptide attached by a peptide bond or via a peptide linker to the first N-terminus of the first domain, and a second dimerizing polypeptide attached by a peptide bond or via a peptide linker to the first C-terminus of the second domain, or c) between a first dimerizing polypeptide attached by a peptide bond or via a peptide linker to the first C-terminus of the first domain, and a second dimerizing polypeptide attached by a peptide bond or via a peptide linker to the first N-terminus of the second domain.

In embodiments of the invention:

a) the first domain is an Fc domain and the second domain is a Fab domain, b) the first and second domains are Fc domains, c) the first and second domains are Fab domains, d) the third and fourth domains are Fab domains, e) the third and/or fourth domain are selected from the group consisting of (i) a secreted protein, and (ii) the extracellular domain of a transmembrane protein, f) the third domain is selected from the group of (i) a secreted protein, and (ii) the extracellular domain of a transmembrane protein, and the fourth domain is a Fab, g) the third domain is IL-15, h) the third domain is IL-15 and the fourth domain is an IL-15Rα sushi domain, i) the third domain is IL-15 and the fourth domain is a Fab, j) the third and fourth domains are each the ACE2 peptidase domain (PD), k) the first and second domains are Fc domains, and the third and fourth domains are selected from the group consisting of (i) a secreted protein, and (ii) the extracellular domain of a transmembrane protein, l) the first and second domains are Fc domains, the third domain is selected from the group consisting of (i) a secreted protein, and (ii) the extracellular domain of a transmembrane protein, and the fourth domain is Fab, m) the first and second domains are Fc domains and the third and fourth domains are Fab domains, n) the first and second domains are Fc domains and the third and fourth domains are each the ACE2 peptidase domain (PD), o) the first domain is an Fc domain and the second, third and fourth domains are Fab domains, p) the first domain is an Fc domain, the second domain is a Fab domain, the third domain is IL-15, and the fourth domain is an IL-15Rα sushi domain, or q) the first domain is an Fc domain, the second domain is a Fab domain, the third domain is IL-15, and the fourth domain is a Fab.

Covalent Linkages

In embodiments of the invention, the non-peptidyl linkage between first domain and the second domain is a covalent linkage.

In embodiments of the invention, the covalent linkage comprises the structure:

a)

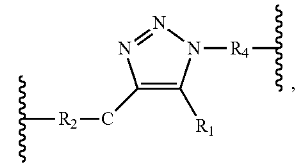

b)

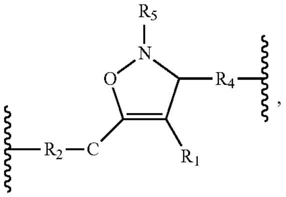

or c)

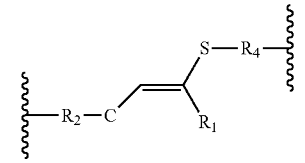

wherein $R_2$ represents an organic structure which connects to the first or second domain and $R_4$ represents an organic structure which connects to the other of the first or second domain, wherein $R_1$ is H or is part of an additional structure that is a cyclic structure, wherein the additional cyclic structure comprises $R_1$ or a portion of $R_1$, and may also comprise $R_2$ or a portion of $R_2$, and the carbon between $R_2$ and the alkene double bond.

In embodiments of the invention, $R_1$ and $R_2$ are linked via at least one direct bond so as to form a cyclic structure comprising a) a portion of $R_1$, b) a portion of $R_2$, c) the carbon between $R_2$ and the alkene double bond, and d) the alkene double bond.

In embodiments of the invention, $R_1$ is selected from the group consisting of:

a)

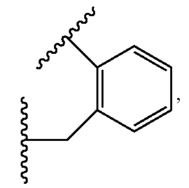

b)

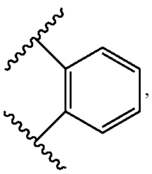

and

-continued c)

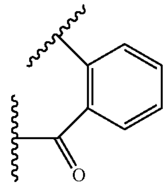

which is optionally substituted at any position.

In embodiments of the invention, the carbon between $R_2$ and the alkene double bond is directly bonded to $R_2$ via a double bond and a single bond.

In embodiments of the invention, $R_2$ is a)

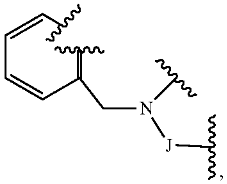

, b)

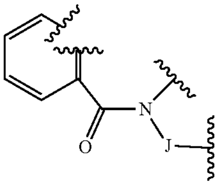

, or c)

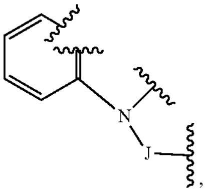

, which is optionally substituted at any position, wherein $R_2$ is attached to $R_1$ via the nitrogen atom of $R_2$, and wherein J is a bond or an organic structure comprising or consisting of a chain of 2, 3, 4, 5, 6, 7, 8, 9, 10 or more moieties selected from the group consisting of [PEG (y)]z, polyalkylene glycol, polyoxyalkylated polyol, polyvinyl alcohol, polyvinyl alkyl ether, poly(lactic acid), poly(lactic-glycolic acid), polysaccharide, a branched residue, $C_1$-$C_4$ alkyl, amine, sulfur, oxygen, succinimide, maleimide, glycerol, triazole, isoxazolidine, $C_1$-$C_4$ acyl, succinyl, malonyl, glutaryl, phthalyl, adipoyl and an amino acid, wherein [PEG(y)]z is:

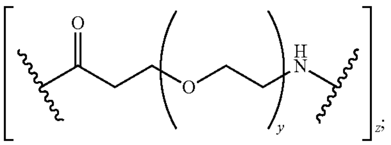

wherein y=1-100 and z=1-10.

In embodiments of the invention, $R_1$ and $R_2$ taken together are:

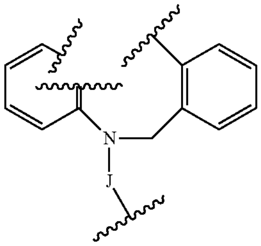

;

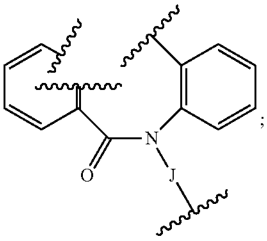

;

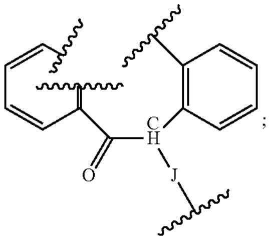

;

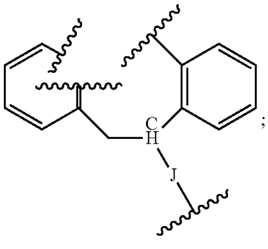

;

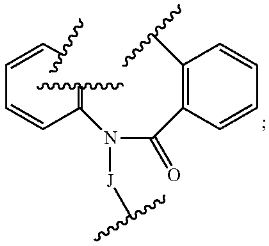

;

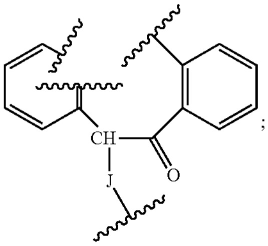

;

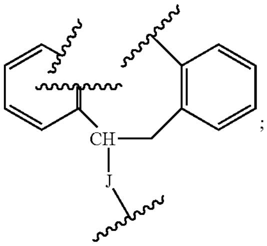

; or

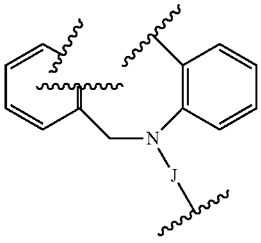

, which is optionally substituted at any position, wherein J is a bond or an organic structure comprising or consisting of a chain of 2, 3, 4, 5, 6, 7, 8, 9, 10 or more moieties selected from the group consisting of [PEG (y)]z, polyalkylene glycol, polyoxyalkylated polyol, polyvinyl alcohol, polyvinyl alkyl ether, poly(lactic acid), poly(lactic-glycolic acid), polysaccharide, a branched residue, $C_1$-$C_4$ alkyl, amine, sulfur, oxygen, succinimide, maleimide, glycerol, triazole, isoxazolidine, $C_1$-$C_4$ acyl, succinyl, malonyl, glutaryl, phthalyl, adipoyl and an amino acid, wherein [PEG(y)]z is:

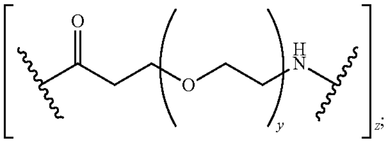

wherein y=1-100 and z=1-10.

In embodiments of the invention, the covalent linkage comprises the structure:

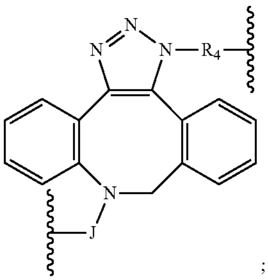
;
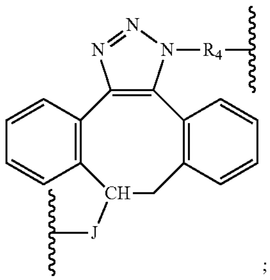
;
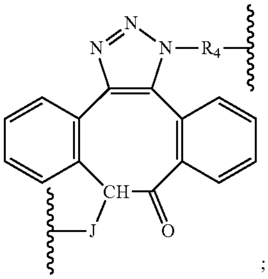
;
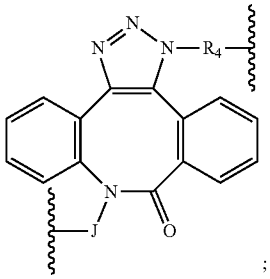
;
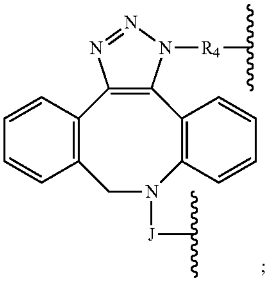
;
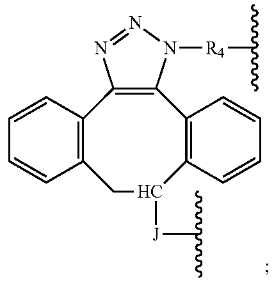
;
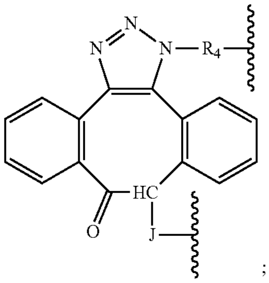
; or
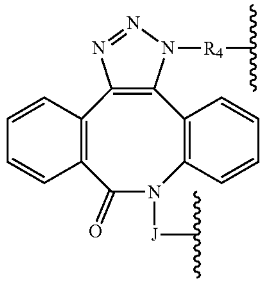
, which is optionally substituted at any position, wherein J is a bond or an organic structure comprising or consisting of a chain of 2, 3, 4, 5, 6, 7, 8, 9, 10 or more moieties selected from the group consisting of [PEG (y)]z, polyalkylene glycol, polyoxyalkylated polyol, polyvinyl alcohol, polyvinyl alkyl ether, poly(lactic acid), poly(lactic-glycolic acid), polysaccharide, a branched residue, $C_1$-$C_4$ alkyl, amine, sulfur, oxygen, succinimide, maleimide, glycerol, triazole, isoxazolidine, $C_1$-$C_4$ acyl, succinyl, malonyl, glutaryl, phthalyl, adipoyl and an amino acid, wherein [PEG(y)]z is:

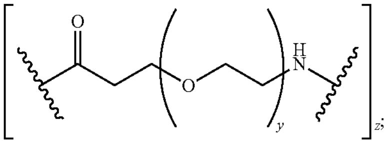

wherein y=1-100 and z=1-10.

In embodiments of the invention, the covalent linkage comprises the structure:

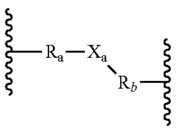

wherein:

a) $X_a$ is a chemical structure selected from the group consisting of:
   i) a chemical structure which comprises a cyclooctane fused to a dihydropyridazine,
   ii) a chemical structure which comprises a cyclooctene fused to a pyridazine,
b) $R_a$ is a bond or a chemical structure which connects $X_a$ to the first N-terminus of the first domain, and
c) $R_b$ is a bond or a chemical structure which connects $X_a$ to the first N-terminus of the second domain.

In embodiments of the invention, $X_a$ comprises the structure

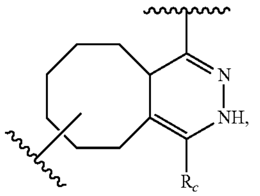

wherein $R_c$ is H, alkyl, or aryl, or a tautomer thereof.

In embodiments of the invention, the covalent linkage comprises the structure

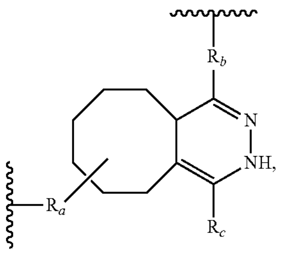

wherein $R_c$ is H, alkyl, or aryl, or a tautomer thereof.

In embodiments of the invention, $R_a$ and $R_b$ are, independently, a bond, or a chemical structure comprising or consisting of a chain of 1, 2, 3, 4, 5, 6, 7, 8, 9, 10 or more moieties, wherein each moiety is independently selected from the group consisting of [PEG(y)]z, polyalkylene glycol, polyoxyalkylated polyol, polyvinyl alcohol, polyvinyl alkyl ether, poly(lactic acid), poly(lactic-glycolic acid), polysaccharide, a branched residue, $C_1$-$C_{10}$ alkyl, $C_3$-$C_{10}$ cycloalkane, $C_2$-$C_{10}$ alkene, $C_5$-$C_{10}$ cycloalkene, amine, sulfur, oxygen, succinimide, maleimide, glycerol, triazole, isoxazolidine, $C_2$-$C_5$ acyl, $C_2$-$C_5$ acylamino, $C_2$-$C_5$ acyloxy, succinyl, malonyl, glutaryl, phthalyl, adipoyl, an amino acid, an aryl group, a heteroaryl group, a carbamate, a chemical structure containing a cyclooctane fused to a dihydropyridazine, a chemical structure containing a cyclooctene fused to a triazole, a chemical structure containing a cyclooctene fused to a isoxazolidine, a dibenzocyclooctene, a dibenzoazacyclooctene,

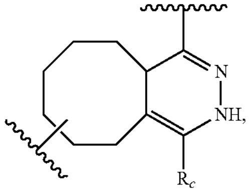 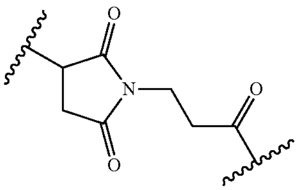 ,

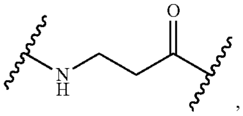 , 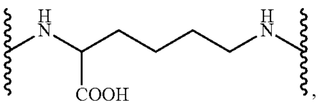 ,

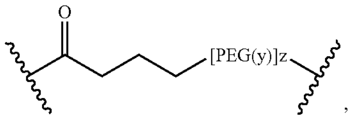 , 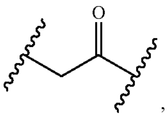 ,

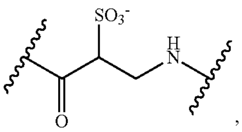 , 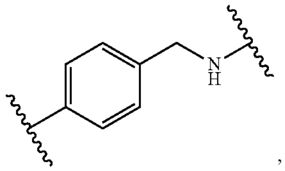 ,

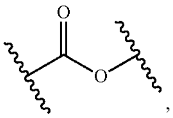 ,

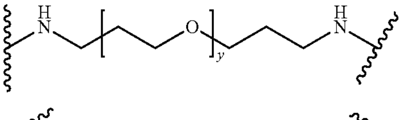 ,

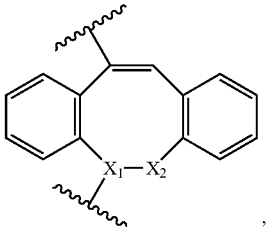 , 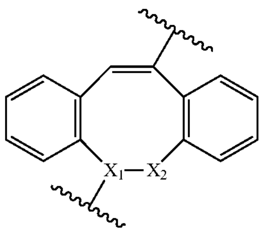 ,

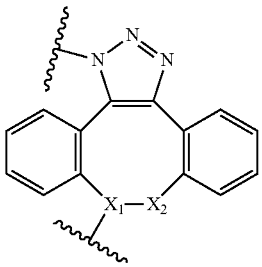 , 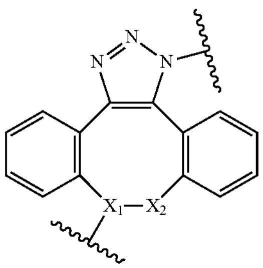 ,

-continued

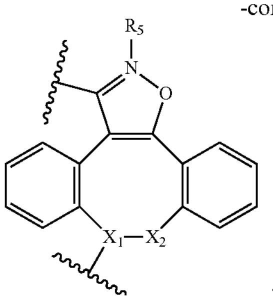 and 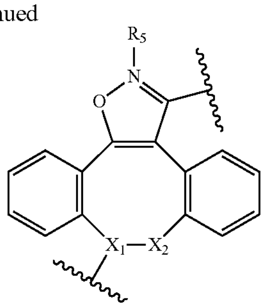 , wherein $X_1$ is CH or N, $X_2$ is $CH_2$ or a carbonyl group, and $R_5$ is an aryl or alkyl group, wherein [PEG(y)]z is:

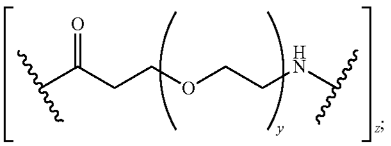

wherein y=1-100 and z=1-10.

In embodiments of the invention, $R_a$ and/or $R_b$ each independently:

a) comprise a [PEG(y)]z group;
b) comprise a polyalkylene glycol, polyoxyalkylated polyol, polyvinyl alcohol, polyvinyl alkyl ether, poly (lactic acid), poly(lactic-glycolic acid), or polysaccharide group;
c) comprise a $C_1$-$C_4$ alkyl group;
d) comprise a succinimide;
e) comprise an amine;
f) comprise a succinyl, malonyl, glutaryl, phthalyl or adipoyl;
g) comprise a malonyl;
h) comprise an amino acid;
i) comprise a cysteine;
j) comprise a lysine;
k) consist of a chain of 3 moieties selected from the group consisting of [PEG(y)]z, polyalkylene glycol, polyoxyalkylated polyol, polyvinyl alcohol, polyvinyl alkyl ether, poly(lactic acid), poly(lactic-glycolic acid), polysaccharide, a branched residue, $C_1$-$C_{10}$ alkyl, $C_3$-$C_{10}$ cycloalkane, $C_2$-$C_{10}$ alkene, $C_5$-$C_{10}$ cycloalkene, amine, sulfur, oxygen, succinimide, maleimide, glycerol, triazole, isoxazolidine, $C_2$-$C_5$ acyl, $C_2$-$C_5$ acylamino, $C_2$-$C_5$ acyloxy, succinyl, malonyl, glutaryl, phthalyl, adipoyl, an amino acid, an aryl group, a heteroaryl group, a carbamate, a chemical structure containing a cyclooctane fused to a dihydropyridazine, a chemical structure containing a cyclooctene fused to a triazole, a chemical structure containing a cyclooctene fused to a isoxazolidine, a dibenzocyclooctene, a dibenzoazacyclooctene,

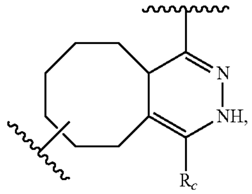

-continued

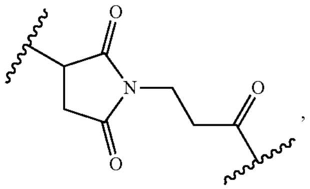
,

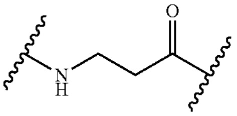
,

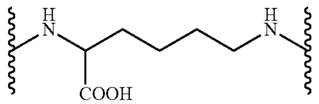
,

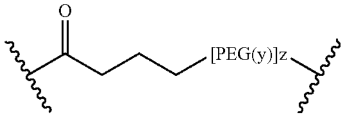
,

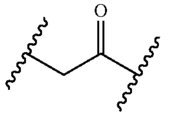
,

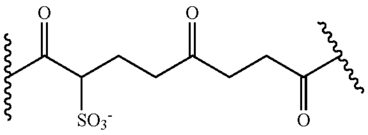
,

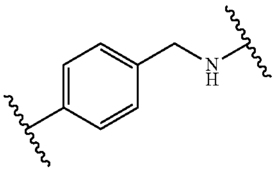
,

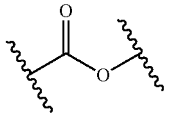
,

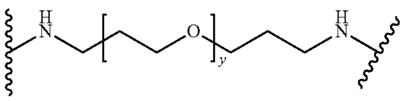
,

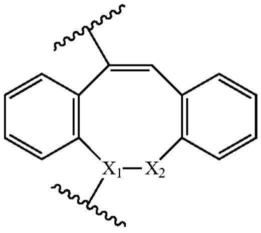
,

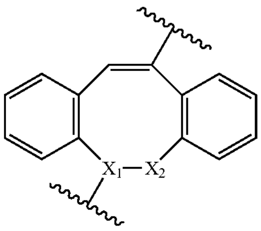
,

-continued

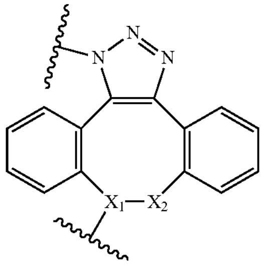
,

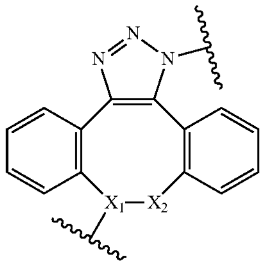
,

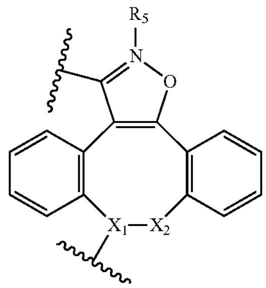
and

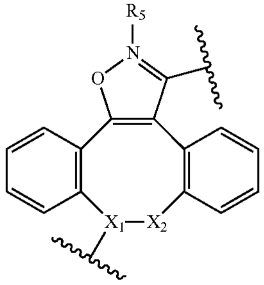
;

l) consist of a chain of 4 moieties selected from the group consisting of [PEG(y)]z, polyalkylene glycol, polyoxyalkylated polyol, polyvinyl alcohol, polyvinyl alkyl ether, poly(lactic acid), poly(lactic-glycolic acid), polysaccharide, a branched residue, $C_1$-$C_{10}$ alkyl, $C_3$-$C_{10}$ cycloalkane, $C_2$-$C_{10}$ alkene, $C_5$-$C_{10}$ cycloalkene, amine, sulfur, oxygen, succinimide, maleimide, glycerol, triazole, isoxazolidine, $C_2$-$C_5$ acyl, $C_2$-$C_5$ acylamino, $C_2$-$C_5$ acyloxy, succinyl, malonyl, glutaryl, phthalyl, adipoyl, an amino acid, an aryl group, a heteroaryl group, a carbamate, a chemical structure containing a cyclooctane fused to a dihydropyridazine, a chemical structure containing a cyclooctene fused to a triazole, a chemical structure containing a cyclooctene fused to a isoxazolidine, a dibenzocyclooctene, a dibenzoazacyclooctene,

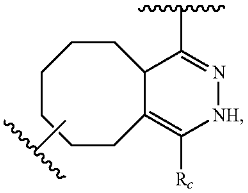,
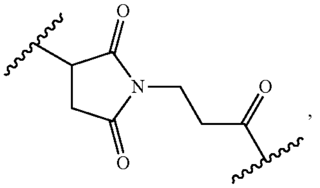,
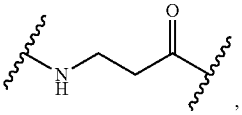,
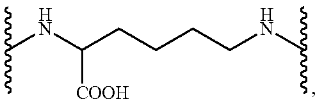,
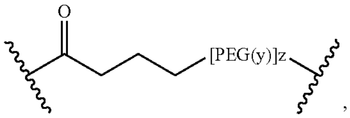,
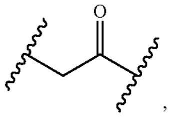,
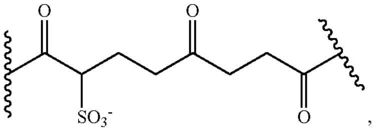,
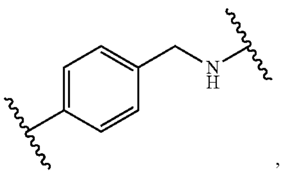,
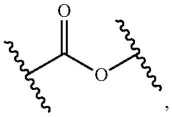,
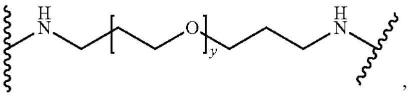,
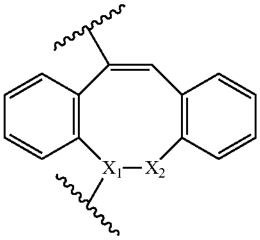,
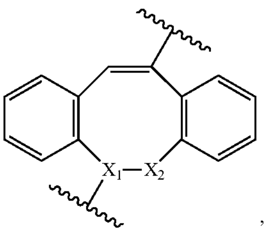,
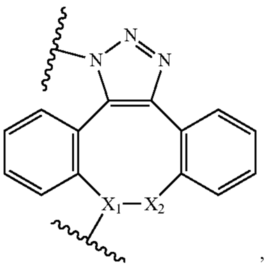,
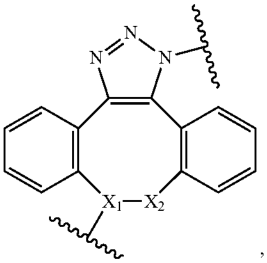,
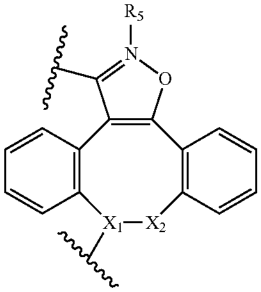

and

-continued

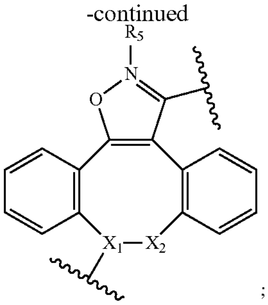;

m) consist of a chain of 5 moieties selected from the group consisting of [PEG(y)]z, polyalkylene glycol, polyoxyalkylated polyol, polyvinyl alcohol, polyvinyl alkyl ether, poly(lactic acid), poly(lactic-glycolic acid), polysaccharide, a branched residue, $C_1$-$C_{10}$ alkyl, $C_3$-$C_{10}$ cycloalkane, $C_2$-$C_{10}$ alkene, $C_5$-$C_{10}$ cycloalkene, amine, sulfur, oxygen, succinimide, maleimide, glycerol, triazole, isoxazolidine, $C_2$-$C_5$ acyl, $C_2$-$C_5$ acylamino, $C_2$-$C_5$ acyloxy, succinyl, malonyl, glutaryl, phthalyl, adipoyl, an amino acid, an aryl group, a heteroaryl group, a carbamate, a chemical structure containing a cyclooctane fused to a dihydropyridazine, a chemical structure containing a cyclooctene fused to a triazole, a chemical structure containing a cyclooctene fused to a isoxazolidine, a dibenzocyclooctene, a dibenzoazacyclooctene,

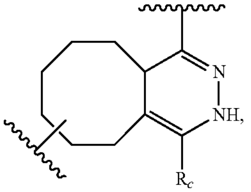,
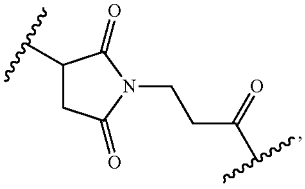,
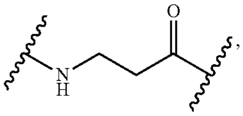,
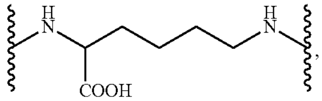,
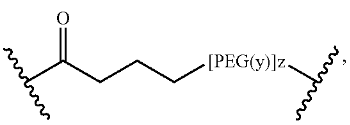,
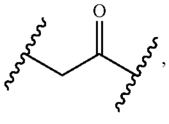,
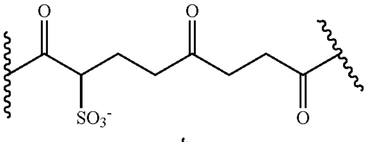,
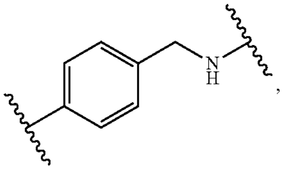,
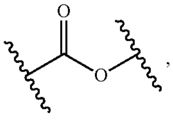, -continued

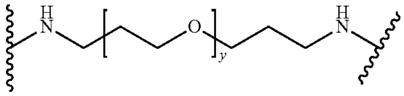
,

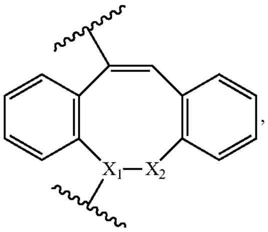
,
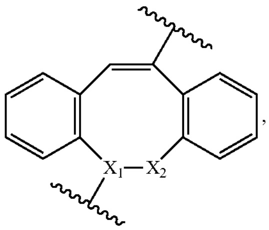
,

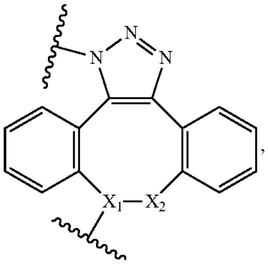
,
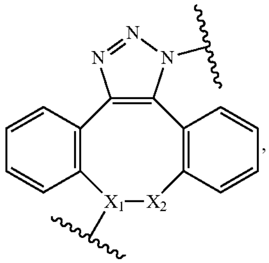
,

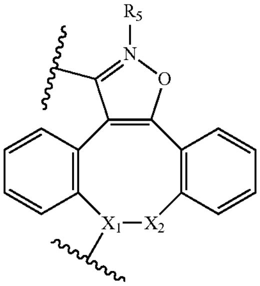
and

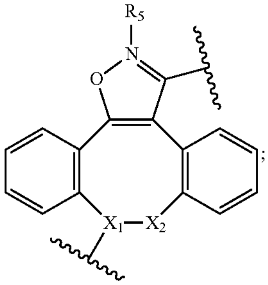
;

n) comprise a [PEG(y)]z group bonded to a lysine;

o) comprise a $C_1$-$C_4$ acyl group bonded to a succinimide group;

p) comprise a lysine bonded to a $C_1$-$C_4$ acyl q) comprise a [PEG(y)]z group, which is bonded to a glutaryl;

r) consist of a chain of three, four or five moieties selected from the group consisting of [PEG(y)]z, $C_2$-$C_5$ acyl, succinyl, malonyl, glutaryl, an amino acid, a chemical structure containing a cyclooctane fused to a dihydropyridazine, a chemical structure containing a cyclooctene fused to a triazole, a chemical structure containing a cyclooctene fused to a isoxazolidine, a dibenzocyclooctene, a dibenzoazacyclooctene,

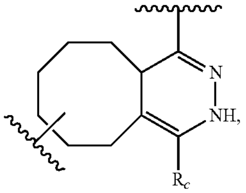

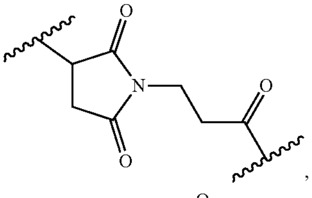
,

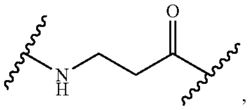
,

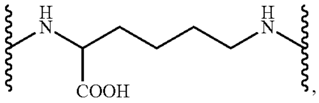
,

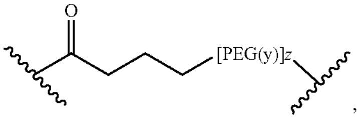
,

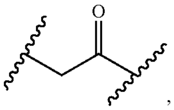
,

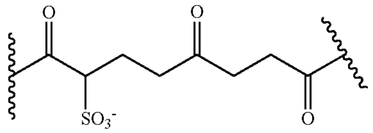
,

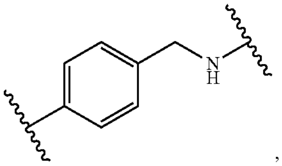
,
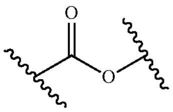
,

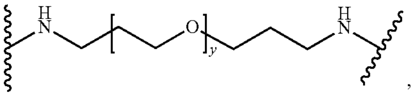
,

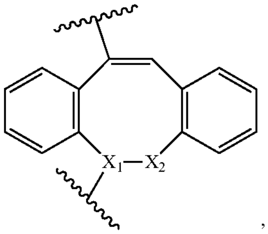
,

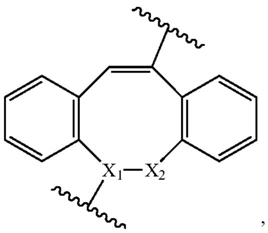
,

-continued
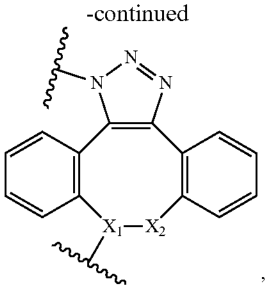
,
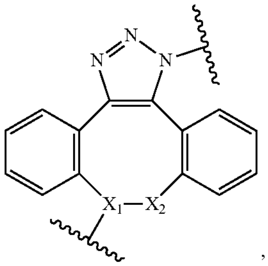
,
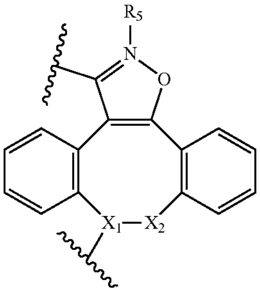
and
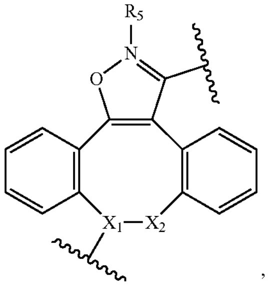
,
wherein $X_1$ is CH or N, $X_2$ is $CH_2$ or a carbonyl group, and $R_5$ is an aryl or alkyl group, wherein [PEG(y)]z is:
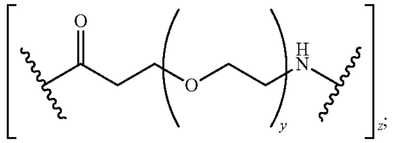
wherein y=1-100 and z=1-10;
s) is a bond;
t) is a cysteine;
u) has a linear structure; or
v) has a branched structure;
w) has the structure:
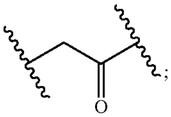 [SMILES: *CC(*)=O]
;
x) is:
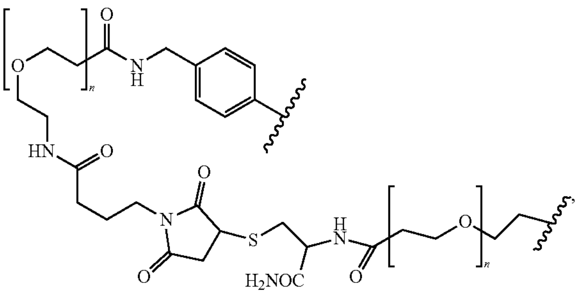
wherein n is 1, 2, 3, 4, 5, 6, 7, 8, 9, 10, 11, 12, 13, 14, 15, 16, 17, 18, 19, 20, 1-30, 1-40, or 1-50;
y) is:
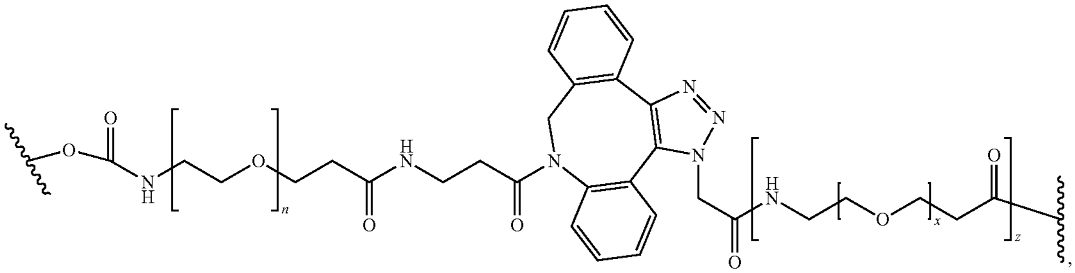
, wherein n is 1, 2, 3, 4, 5, 6, 7, 8, 9, 10, 11, 12, 13, 14, 15, 16, 17, 18, 19, 20, 1-30, 1-40, or 1-50, x is 1, 2, 3, 4, 5, 6, 7, 8, 9, 10, 11, 12, 13, 14, 15, 16, 17, 18, 19, 20, 1-30, 1-40, or 1-50 and z is 1, 2, 3, 4, 5, 6, 7, 8, 9, 10, 11, 12, 13, 14, 15, 16, 17, 18, 19, 20, 1-30, 1-40, or 1-50;

z) is:

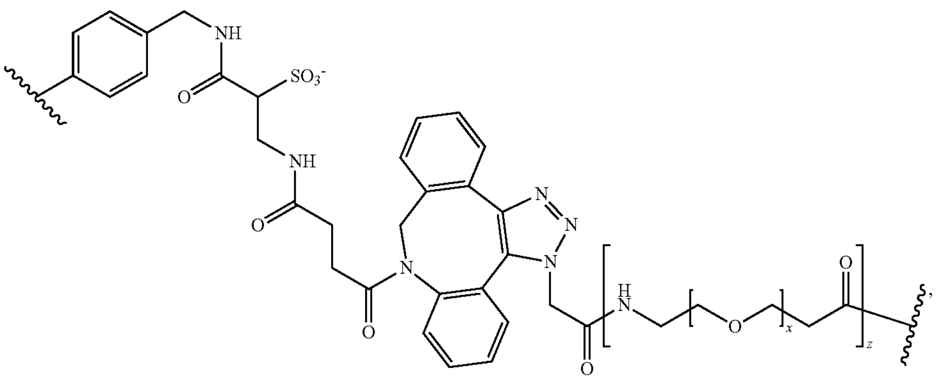

wherein x is 1, 2, 3, 4, 5, 6, 7, 8, 9, 10, 11, 12, 13, 14, 15, 16, 17, 18, 19, 20, 1-30, 1-40, or 1-50 and z is 1, 2, 3, 4, 5, 6, 7, 8, 9, 10, 11, 12, 13, 14, 15, 16, 17, 18, 19, 20, 1-30, 1-40, or 1-50; or aa) is:

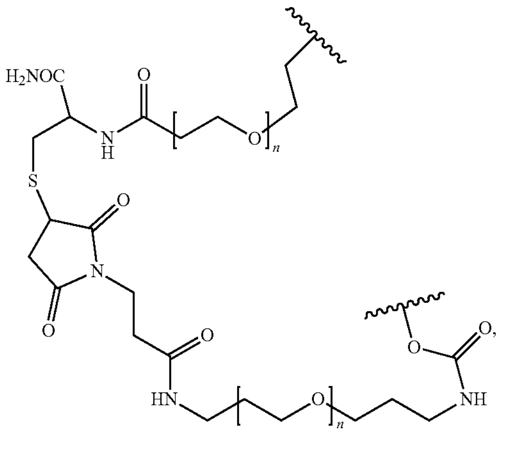

wherein n is 1, 2, 3, 4, 5, 6, 7, 8, 9, 10, 11, 12, 13, 14, 15, 16, 17, 18, 19, 20, 1-30, 1-40, or 1-50.

In embodiments of the invention, $R_a$ and/or $R_b$ comprise the moiety

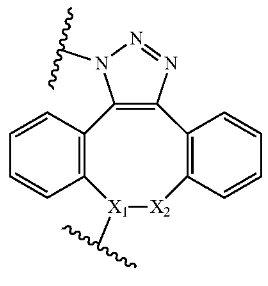

or

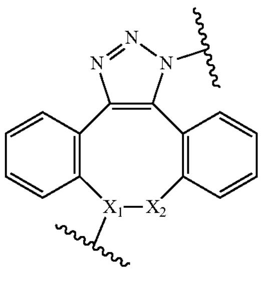

wherein $X_1$ is CH or N and $X_2$ is $CH_2$ or a carbonyl group.

Non-Covalent Linkages

In embodiments of the invention, the non-peptidyl linkage is a non-covalent linkage between a first dimerizing polypeptide attached to the first domain and a second dimerizing polypeptide attached to the second domain.

In embodiments of the invention, the first and second dimerizing polypeptides are selected from the group consisting of:

a) dimerizing domains of an extracellular protein dimer, and b) dimerizing domains of an intracellular protein dimer.

In embodiments of the invention, the first and second dimerizing polypeptides are selected from the group consisting of:

a) a leucine zipper domain, b) a collectrin-like domain (CLD), c) a collectrin domain (CD), d) a CD8 alpha extracellular domain, and e) a CD8 beta extracellular domain.

In preferred embodiments of the tetrahedral antibody of the invention, the first and second dimerizing polypeptides are selected from a collectrin-like domain (CLD) and a collectrin domain (CD), preferably a collectrin-like domain (CLD).

In embodiments of the invention:

a) the first dimerizing polypeptide is the same as the second dimerizing polypeptide, and b) the dimerizing polypeptides form a homodimer.

In embodiments of the invention:

a) the first dimerizing polypeptide is different than the second dimerizing polypeptide, and b) the first and second dimerizing polypeptides form a heterodimer.

In embodiments of the invention wherein the first and second dimerizing polypeptides form a heterodimer, the dimerizing polypeptides are collectrin-like domain (CLD), and the CLD comprises substitutions that disrupt homodimer formation in the CLD dimerizing polypeptide, preferably wherein the substitutions are at Arg652, Arg710, Tyr641, Tyr633, Asn638, Glu639, Gln653, Asn636, Ser709, Asp713, and/or Arg716, more preferably wherein Tyr641 and Tyr633 are substituted with positively charged amino acids lysine, arginine or histidine and Arg652 and Arg710 are substituted with the negatively charged amino acids glutamic acid or aspartic acid or the positively amino acid lysine.

In embodiments of the invention wherein the first and second dimerizing polypeptides form a heterodimer, the dimerizing polypeptides are collectrin, and the collectrin dimerizing polypeptide comprises substitutions that disrupt homodimer formation in the collectrin dimerizing polypeptide, preferably wherein the substitutions are at Arg59, Arg111, Tyr48, and/or Tyr40, more preferably wherein Tyr48 and/or Tyr40 are substituted with positively charged amino acids lysine, arginine or histidine and Arg59 and/or Arg111 are substituted with the negatively charged amino acids glutamic acid or aspartic acid or the positively charge amino acid lysine.

In embodiments wherein the dimerizing polypeptides are collectrin-like domain (CLD), and, the CLD comprises substitutions that promote heterodimer formation in the CLD dimerizing polypeptide, and preferably:

a) Tyr633 on either of the first or second CLD dimerizing polypeptide is substituted, preferably with either a positively charge or negatively charged amino acid;
b) Tyr641 on either of the first or second CLD dimerizing polypeptide is substituted, preferably with either a positively charge or negatively charged amino acid;
c) Arg652 on either of the first or second CLD dimerizing polypeptide is substituted, preferably with either a positively charge or negatively charged amino acid;
d) Arg710 on either of the first or second CLD dimerizing polypeptide is substituted, preferably with either a positively charge or negatively charged amino acid;
e) Ser709 on either of the first or second CLD dimerizing polypeptide is substituted, preferably with either a positively charge or negatively charged amino acid; and/or
f) Asp713 on either of the first or second CLD dimerizing polypeptide is substituted, preferably with either a positively charge or negatively charged amino acid.

In embodiments wherein the dimerizing polypeptides are collectrin and the collectrin dimerizing polypeptide comprises substitutions that promote heterodimer formation in the collectrin dimerizing polypeptide, preferably a) Tyr40 on either the first or second collectrin dimerizing polypeptide is substituted, preferably with either a positively charge or negatively charged amino acid;
b) Tyr48 on either the first or second collectrin dimerizing polypeptide is substituted, preferably with either a positively charge or negatively charged amino acid;
c) Arg59 on either the first or second collectrin dimerizing polypeptide is substituted, preferably with either a positively charge or negatively charged amino acid; and/or
d) Arg111 on either the first or second collectrin dimerizing polypeptide is substituted, preferably with either a positively charge or negatively charged amino acid.

In embodiments wherein the dimerizing polypeptides are collectrin-like domain (CLD), and, the CLD comprises substitutions that promote heterodimer formation in the CLD dimerizing polypeptide, and preferably:

a) Tyr633 on the first CLD dimerizing polypeptide is substituted with either a positively charge or negatively charged amino acid, and Arg710 on the second CLD dimerizing polypeptide is substituted with the other of a positively charge or negatively charged amino acid;
b) Tyr633 on the second CLD dimerizing polypeptide is substituted with either a positively charge or negatively charged amino acid, and Arg710 on the first CLD dimerizing polypeptide is substituted with the other of a positively charge or negatively charged amino acid;
c) Tyr641 on the first CLD dimerizing polypeptide is substituted with either a positively charge or negatively charged amino acid, and Arg652 on the second CLD dimerizing polypeptide is substituted with the other of a positively charge or negatively charged amino acid;
d) Tyr641 on the second CLD dimerizing polypeptide is substituted with either a positively charge or negatively charged amino acid, and Arg652 on the first CLD dimerizing polypeptide is substituted with the other of a positively charge or negatively charged amino acid;
e) Arg652 on the first CLD dimerizing polypeptide is substituted with either a positively charge or negatively charged amino acid, and Asn638 on the second CLD dimerizing polypeptide is substituted with the other of a positively charge or negatively charged amino acid;
f) Arg652 on the second CLD dimerizing polypeptide is substituted with either a positively charge or negatively charged amino acid, and Arg638 on the first CLD dimerizing polypeptide is substituted with the other of a positively charge or negatively charged amino acid;
g) Arg710 on the first CLD dimerizing polypeptide is substituted with either a positively charge or negatively charged amino acid, and Glu639 on the second CLD dimerizing polypeptide is substituted with the other of a positively charge or negatively charged amino acid;
h) Arg710 on the second CLD dimerizing polypeptide is substituted with either a positively charge or negatively charged amino acid, and Glu639 on the first CLD dimerizing polypeptide is substituted with the other of a positively charge or negatively charged amino acid;
i) Ser709 on the first CLD dimerizing polypeptide is substituted with either a positively charge or negatively charged amino acid, and Arg716 on the second CLD dimerizing polypeptide is substituted with the other of a positively charge or negatively charged amino acid;
j) Ser709 on the second CLD dimerizing polypeptide is substituted with either a positively charge or negatively charged amino acid, and Arg716 on the first CLD dimerizing polypeptide is substituted with the other of a positively charge or negatively charged amino acid;
k) Asp713 on the first CLD dimerizing polypeptide is substituted with either a positively charge or negatively charged amino acid, and Arg716 on the second CLD dimerizing polypeptide is substituted with the other of a positively charge or negatively charged amino acid; and/or
l) Asp713 on the second CLD dimerizing polypeptide is substituted with either a positively charge or negatively charged amino acid, and Arg716 on the first CLD dimerizing polypeptide is substituted with the other of a positively charge or negatively charged amino acid;

In embodiments wherein the dimerizing polypeptides are collectrin and the collectrin dimerizing polypeptide comprises substitutions that promote heterodimer formation in the collectrin dimerizing polypeptide, preferably a) Tyr40 on the first collectrin dimerizing polypeptide is substituted with either a positively charge or negatively charged amino acid, and Arg111 on the second collectrin dimerizing polypeptide is substituted with the other of a positively charge or negatively charged amino acid;
b) Tyr40 on the second collectrin dimerizing polypeptide is substituted with either a positively charge or negatively charged amino acid, and Arg111 on the first collectrin dimerizing polypeptide is substituted with the other of a positively charge or negatively charged amino acid;
c) Tyr48 on the first collectrin dimerizing polypeptide is substituted with either a positively charge or negatively charged amino acid, and Arg59 on the second collectrin dimerizing polypeptide is substituted with the other of a positively charge or negatively charged amino acid; and/or d) Tyr48 on the second collectrin dimerizing polypeptide is substituted with either a positively charge or negatively charged amino acid, and Arg59 on the first collectrin dimerizing polypeptide is substituted with the other of a positively charge or negatively charged amino acid.

In embodiments of the invention wherein the first and second dimerizing polypeptides form a heterodimer:

a) the first and second dimerizing polypeptides are selected from the group consisting of:
   i) a T cell receptor alpha and T cell receptor beta extracellular domain,
   ii) a T cell receptor gamma and T cell receptor extracellular domain,
   iii) an MHC class I alpha extracellular domain and beta-2 microglobulin
   iv) an MHC class II alpha and MHC class II beta extracellular domain, and
   v) a CD8 alpha and CD8 beta extracellular domain,
b) the first dimerizing polypeptide is different from the second dimerizing polypeptide, and
c) the first and second dimerizing polypeptides form a heterodimer.

In some of these embodiments of the invention, the first and second dimerizing polypeptides, when in the presence of each other, form less than 30%, 20%, 10%, 5%, 4%, 3%, 2%, or 1% homodimers.

In embodiments of the invention, the first dimerizing polypeptide comprises one or more disulfide bonds with the second dimerizing polypeptide, and preferably:

a) the one or more disulfide bonds are at the interface between the first and second dimerizing polypeptides, more preferably:
   i) if the first and second dimerizing polypeptides are collectrin-like domain or collectrin, and the one or more disulfide bonds are in the second and fourth helices of the collectrin-like domain or corresponding region in collectrin, or
b) the one or more disulfide bonds are between an immunoglobulin hinge region, or portion thereof comprising at least one cysteine, appended at the N-terminus and/or C-terminus of the first and second dimerizing polypeptides, wherein said hinge regions are appended directly to the first and second dimerizing polypeptides or via peptide linkers, preferably wherein the first and second dimerizing polypeptides are collectrin-like domain or collectrin.

Domains

In embodiments of the invention:

a) the third and fourth domains are each the ACE2 peptidase domain (PD), and
b) the first and second dimerizing polypeptides are each the ACE2 collectrin-like domain (CLD), In an embodiment wherein the first and second domains are Fc domains, each polypeptide chain of the tetrahedral antibody comprises the amino acid sequence set forth in any one of SEQ ID NOs: 74-119, more preferably SEQ ID NO: 78.

In embodiments of the invention, the first and second domains are Fc domains.

In embodiments of the invention:

a) the first and second domains are Fc domains and the third domain is a first type of Fab domain,
b) the first and second domains are Fc domains and the third and fourth domains are independently selected from the group consisting of a first type of Fab domain and a second type of Fab domain,
c) the first domain is an Fc domain, and the second and third domains are independently selected from the group consisting of a first type of Fab domain and a second type of Fab domain, or
d) the first domain is an Fc domain, and the second, third, and fourth domains are independently selected from the group consisting of a first type of Fab domain, a second type of Fab domain, and a third type of Fab domain.

In embodiments of the invention the tetrahedral antibody of additionally comprises a fifth domain, wherein the fifth domain is attached at its C-terminus by a peptide bond or via a peptide linker to:

a) the N-terminus of the first dimerizing polypeptide,
b) the second N-terminus of the first domain, or
c) the N-terminus of a third dimerizing polypeptide, wherein the third dimerizing polypeptide is attached at its C-terminus by a peptide bond or via a peptide linker to the second N-terminus of the first domain.

In embodiments of the invention:

a) the first and second domains are Fc domains and the fifth domain is a first type of Fab domain,
b) the first and second domains are Fc domains, and the third and fifth domains are independently selected from the group consisting of a first type of Fab domain and a second type of Fab domain,
c) the first and second domains are Fc domains, and the fourth and fifth domains are independently selected from the group consisting of a first type of Fab domain and a second type of Fab domain,
d) the first and second domains are Fc domains, and the third, fourth, and fifth domains are independently selected from the group consisting of a first type of Fab domain, a second type of Fab domain, and a third type of Fab domain,
e) the first domain is an Fc domain, and the second and fifth domains are independently selected from the group consisting of a first type of Fab domain and a second type of Fab domain,
f) the first domain is an Fc domain, and the second, third, and fifth domains are independently selected from the group consisting of a first type of Fab domain, a second type of Fab domain, and a third type of Fab domain,
g) the first domain is an Fc domain, and the second, fourth, and fifth domains are independently selected from the group consisting of a first type of Fab domain, a second type of Fab domain, and a third type of Fab domain, or
h) the first domain is an Fc domain, and the second, third, fourth, and fifth domains are independently selected from the group consisting of a first type of Fab domain, a second type of Fab domain, a third type of Fab domain, and a fourth type of Fab domain.

Tetrahedral Antibodies Comprising a Fifth and/or Sixth Domain

In embodiments of the invention, the tetrahedral antibody additionally comprises a fifth and/or sixth domain, wherein:

a) the first domain is joined to the second domain via a first dimerizing polypeptide attached to the first N-terminus of the first domain, and wherein
   i) the fifth domain is attached at its C-terminus by a peptide bond or via a peptide linker to:
      (1) the N-terminus of the first dimerizing polypeptide, (2) the second N-terminus of the first domain, or (3) the N-terminus of a third dimerizing polypeptide, wherein the third dimerizing polypeptide is attached at its C-terminus by a peptide bond or via a peptide linker to the second N-terminus of the first domain, b) the first domain is joined to the second domain via a first dimerizing polypeptide attached to the first C-terminus of the first domain, and wherein i) the fifth domain is attached at its N-terminus by a peptide bond or via a peptide linker to:

(1) the C-terminus of the first dimerizing polypeptide, (2) the second C-terminus of the first domain, or (3) the C-terminus of a third dimerizing polypeptide, wherein the third dimerizing polypeptide is attached at its N-terminus by a peptide bond or via a peptide linker to the second C-terminus of the first domain, c) the second domain is joined to the first domain via a second dimerizing polypeptide attached to the first N-terminus of the second domain, and wherein i) the sixth domain is attached at its C-terminus by a peptide bond or via a peptide linker to:

(1) the N-terminus of the second dimerizing polypeptide, (2) the second N-terminus of the second domain, or (3) the N-terminus of a fourth dimerizing polypeptide, wherein the fourth dimerizing polypeptide is attached at its C-terminus by a peptide bond or via a peptide linker to the second N-terminus of the second domain, or d) the second domain is joined to the first domain via a second dimerizing polypeptide attached to the first C-terminus of the second domain, and wherein i) the sixth domain is attached at its N-terminus by a peptide bond or via a peptide linker to:

(1) the C-terminus of the second dimerizing polypeptide, (2) the second C-terminus of the second domain, or ii) the C-terminus of a fourth dimerizing polypeptide, wherein the fourth dimerizing polypeptide is attached at its N-terminus by a peptide bond or via a peptide linker to the second C-terminus of the second domain.

In embodiments of the invention:

a) the first and second domains are Fc domains and the fifth domain is a first type of Fab domain, b) the first and second domains are Fc domains, and the third and fifth domains are independently selected from the group consisting of a first type of Fab domain and a second type of Fab domain, c) the first and second domains are Fc domains, and the fourth and fifth domains are independently selected from the group consisting of a first type of Fab domain and a second type of Fab domain, d) the first and second domains are Fc domains, and the third, fourth, and fifth domains are independently selected from the group consisting of a first type of Fab domain, a second type of Fab domain, and a third type of Fab domain, e) the first domain is an Fc domain, and the second and fifth domains are independently selected from the group consisting of a first type of Fab domain and a second type of Fab domain, f) the first domain is an Fc domain, and the second, third, and fifth domains are independently selected from the group consisting of a first type of Fab domain, a second type of Fab domain, and a third type of Fab domain, g) the first domain is an Fc domain, and the second, fourth, and fifth domains are independently selected from the group consisting of a first type of Fab domain, a second type of Fab domain, and a third type of Fab domain, or h) the first domain is an Fc domain, and the second, third, fourth, and fifth domains are independently selected from the group consisting of a first type of Fab domain, a second type of Fab domain, a third type of Fab domain, and a fourth type of Fab domain.

Tetrahedral Antibodies Containing the ACE2 PD

In embodiments of the invention:

a) the third, fourth, fifth and sixth domains are each the ACE2 PD and the dimerizing polypeptides are each the ACE2 CLD, b) the first and second domains are Fc domains, the third, fourth, fifth and sixth domains are each the ACE2 PD and the dimerizing polypeptides are each the ACE2 CLD, preferably wherein the first and second domains are each connected to their respective dimerizing polypeptides via a peptide linker, c) the third and fourth domains are each the ACE2 PD, the fifth and sixth domains are each Fab domains, and the dimerizing polypeptides are each the ACE2 CLD, d) the first and second domains are Fc domains, the third and fourth domains are each the ACE2 PD, the fifth and sixth domains are each Fab domains, and the dimerizing polypeptides are each the ACE2 CLD, preferably wherein the first and second domains are each connected to their respective dimerizing polypeptides via a peptide linker, e) the third and fourth domains are each Fab domains, the fifth and sixth domains are each the ACE2 PD, and the dimerizing polypeptides are each the ACE2 CLD, or f) the first and second domains are Fc domains, the third and fourth domains are each Fab domains, the fifth and sixth domains are each the ACE2 PD, and the dimerizing polypeptides are each the ACE2 CLD, preferably wherein the first and second domains are each connected to their respective dimerizing polypeptides via a peptide linker, or g) the first and second domains are Fc domains, the third and fourth domains are the ACE2 PD, the fifth and sixth domains are Fab domains, the dimerizing polypeptides are each the ACE2 CLD, and the first and second domains are each connected to their respective dimerizing polypeptides via a peptide linker, preferably wherein such domains and linkers are characterized by one or more or all of the following features:

i) the Fc domains are characterized by one or more or all of the following features:

(1) are heterodimers, (2) are IgG1 Fc domains, (3) comprise a silencing mutation such that the Fc domain lacks Fc gamma receptor binding activity, preferably wherein such mutation is one of the following combinations of mutations:

a. P329G/L234A/L235A (PGLALA), b. L234A/L235A (LALA), c. P331S/L234A/L235A, d. L234F/L235E/P331S, and e. L234F/L235E/P329G, (4) comprise a mutation that enhances FcRn activity, preferably wherein such mutation extends the half-life of the tetrahedral antibody, preferably wherein the mutation is a combination the following mutations: L309D/Q311H/N434S (DHS), (5) comprise a mutation that enhances Fc gamma receptor binding activity, preferably wherein such mutation is one of the following combinations of mutations:

a. a combination of the following mutations: S239D/I332E, b. S239D preferably wherein the other polypeptide chain of the Fc domain comprises a I332E mutation, or c. I332E, preferably wherein the other polypeptide chain of the Fc domain comprises a S239D mutation, and, (6) comprise a mutation that ablates their Protein A binding site, preferably wherein such mutation is H435R/Y436F (HY/RF), ii) the ACE2 peptidase domains comprise a mutation which blocks its angiotensin converting enzyme activity, preferably wherein such mutation is an H378A mutation, iii) the Fab domains are chimeric Fab domains comprising a murine variable region, iv) the peptide linkers each have a length of 23 amino acids and are derived from the stalk region of a TNF receptor, preferably wherein the TNF receptor is TNF receptor 1B, still more preferably wherein the peptide linker consists of the amino acid sequence set forth in SEQ ID NO: 4468, v) such domains and peptide linkers are formed by two or three different types of polypeptide chains.

In embodiments of the invention:

a) the third and fourth domains are each the ACE2 PD, b) the fifth domain, if present, is attached at its C-terminus by a peptide bond or via a peptide linker to the N-terminus of a third dimerizing polypeptide, wherein the third dimerizing polypeptide is attached at its C-terminus by a peptide bond or via a peptide linker to the second N-terminus of the first domain, c) the sixth domain, if present, is attached at its C-terminus by a peptide bond or via a peptide linker to the N-terminus of a fourth dimerizing polypeptide, wherein the fourth dimerizing polypeptide is attached at its C-terminus by a peptide bond or via a peptide linker to the second N-terminus of the second domain, and d) the first, second, third, and fourth dimerizing polypeptides are each the ACE2 CLD.

In embodiments of the invention, the ACE2 PD comprises or consists of amino acids 18-615 of the ACE2 protein or a portion thereof.

In embodiments of the invention, the ACE2 CLD comprises or consists of amino acids 616-740 of the ACE2 protein or a portion thereof.

In embodiments of the invention, the ACE2 PD is catalytically active.

In embodiments of the invention, the ACE2 PD is catalytically inactive.

In embodiments of the invention, ACE2 PD comprises a R273Q, or a H378A mutation.

In embodiments of the invention, the Fc domains lack Fc gamma receptor binding activity.

In embodiments of the invention, the Fc domains comprise:

a) a P329G mutation, a L234A mutation and a L235A mutation (PGLALA);

b) a L234A mutation and a L235A mutation (LALA), c) a P331S mutation, a L234A mutation, and a L235A mutation, d) a L234F mutation, a L235E mutation, and a P331S mutation, or e) a L234F mutation, a L235E mutation, and a P329G mutation.

In embodiments of the invention, the Fc domains comprise a mutation which enhances FcRn activity and/or half-life. In embodiments of the invention, such mutations are selected from any of the following combinations of mutations:

a) M252Y/S254T/T256E (YTE), b) L309D/Q311H/N434S (DHS), c) M428L/N434S (LS)

In embodiments of the invention, the Fc domains comprise a mutation which enhances Fc gamma receptor binding activity. In embodiments of the invention, such mutations are selected from:

a) S239D/I332E, b) S239D, preferably wherein the other polypeptide chain of the Fc domain comprises a I332E mutation, or c) I332E, preferably wherein the other polypeptide chain of the Fc domain comprises a S239D mutation.

In embodiments of the invention, the Fc domains comprise a mutation that ablates their Protein A binding site, preferably wherein such mutation is H435R/Y436F (HY/RF).

In embodiments of the invention, the Fab domains are chimeric Fab domains comprising a murine variable region.

In embodiments of the invention, the tetrahedral antibody comprises one or more Fab domains and the one or more Fab domains comprise the complementarity-determining region (CDR) of the Fab domain of the B13A antibody.

In embodiments of the invention, the one or more Fab domains comprise the VH and VL regions from the B13A antibody, preferably wherein the VH and VL regions comprise the amino acid sequences set forth in SEQ ID NOs 463 and 464 or variants thereof with at least 90%, preferably at least 95%, more preferably at least 98% identity to said sequences.

In embodiments of the invention, the one or more Fab domains are humanized.

In embodiments of the invention, the first and second domains are Fc domains, the third and fourth domains are the ACE2 PD, the fifth and sixth domains are Fab domains, the dimerizing polypeptides are each the ACE2 CLD, and the first and second domains are each connected to their respective dimerizing polypeptides via a peptide linker, wherein the domains and peptide linkers of the tetrahedral antibody are formed by three different types of polypeptide chains. In a preferred embodiment the three different types of polypeptide chains are denoted H1, L2, and H2, and:

a) the H1 chain comprises the amino acid sequence set forth in SEQ ID NO: 524, the L2 chain comprises the amino acid sequence set forth in SEQ ID NO: 465, and the H2 chain comprises the amino acid sequence set forth in SEQ ID NO: 535, or the H1, L2 and H2 chains are variants with at least 90%, preferably at least 95%, more preferably at least 98% identity to said sequences;

b) the H1 chain comprises the amino acid sequence set forth in SEQ ID NO: 473, the L2 chain comprises the amino acid sequence set forth in SEQ ID NO: 465, and the H2 chain comprises the amino acid sequence set forth in SEQ ID NO: 485, or the H1, L2 and H2 chains are variants with at least 90%, preferably at least 95%, more preferably at least 98% identity to said sequences;

c) the H1 chain comprises the amino acid sequence set forth in SEQ ID NO: 526, the L2 chain comprises the amino acid sequence set forth in SEQ ID NO: 465, and the H2 chain comprises the amino acid sequence set forth in SEQ ID NO: 527, or the H1, L2 and H2 chains are variants with at least 90%, preferably at least 95%, more preferably at least 98% identity to said sequences;

d) the H1 chain comprises the amino acid sequence set forth in SEQ ID NO: 514, the L2 chain comprises the amino acid sequence set forth in SEQ ID NO: 465, and the H2 chain comprises the amino acid sequence set forth in SEQ ID NO: 528, or the H1, L2 and H2 chains are variants with at least 90%, preferably at least 95%, more preferably at least 98% identity to said sequences;

e) the H1 chain comprises the amino acid sequence set forth in SEQ ID NO: 529, the L2 chain comprises the amino acid sequence set forth in SEQ ID NO: 465, and the H2 chain comprises the amino acid sequence set forth in SEQ ID NO: 530, or the H1, L2 and H2 chains are variants with at least 90%, preferably at least 95%, more preferably at least 98% identity to said sequences;

f) the H1 chain comprises the amino acid sequence set forth in SEQ ID NO: 518, the L2 chain comprises the amino acid sequence set forth in SEQ ID NO: 465, and the H2 chain comprises the amino acid sequence set forth in SEQ ID NO: 531; or the H1, L2 and H2 chains are variants with at least 90%, preferably at least 95%, more preferably at least 98% identity to said sequences, g) the H1 chain comprises the amino acid sequence set forth in SEQ ID NO: 532, the L2 chain comprises the amino acid sequence set forth in SEQ ID NO: 465, and the H2 chain comprises the amino acid sequence set forth in SEQ ID NO: 533, or the H1, L2 and H2 chains are variants with at least 90%, preferably at least 95%, more preferably at least 98% identity to said sequences; or h) the H1 chain comprises the amino acid sequence set forth in SEQ ID NO: 522, the L2 chain comprises the amino acid sequence set forth in SEQ ID NO: 465, and the H2 chain comprises the amino acid sequence set forth in SEQ ID NO: 534, or the H1, L2 and H2 chains are variants with at least 90%, preferably at least 95%, more preferably at least 98% identity to said sequences.

Figure 31:
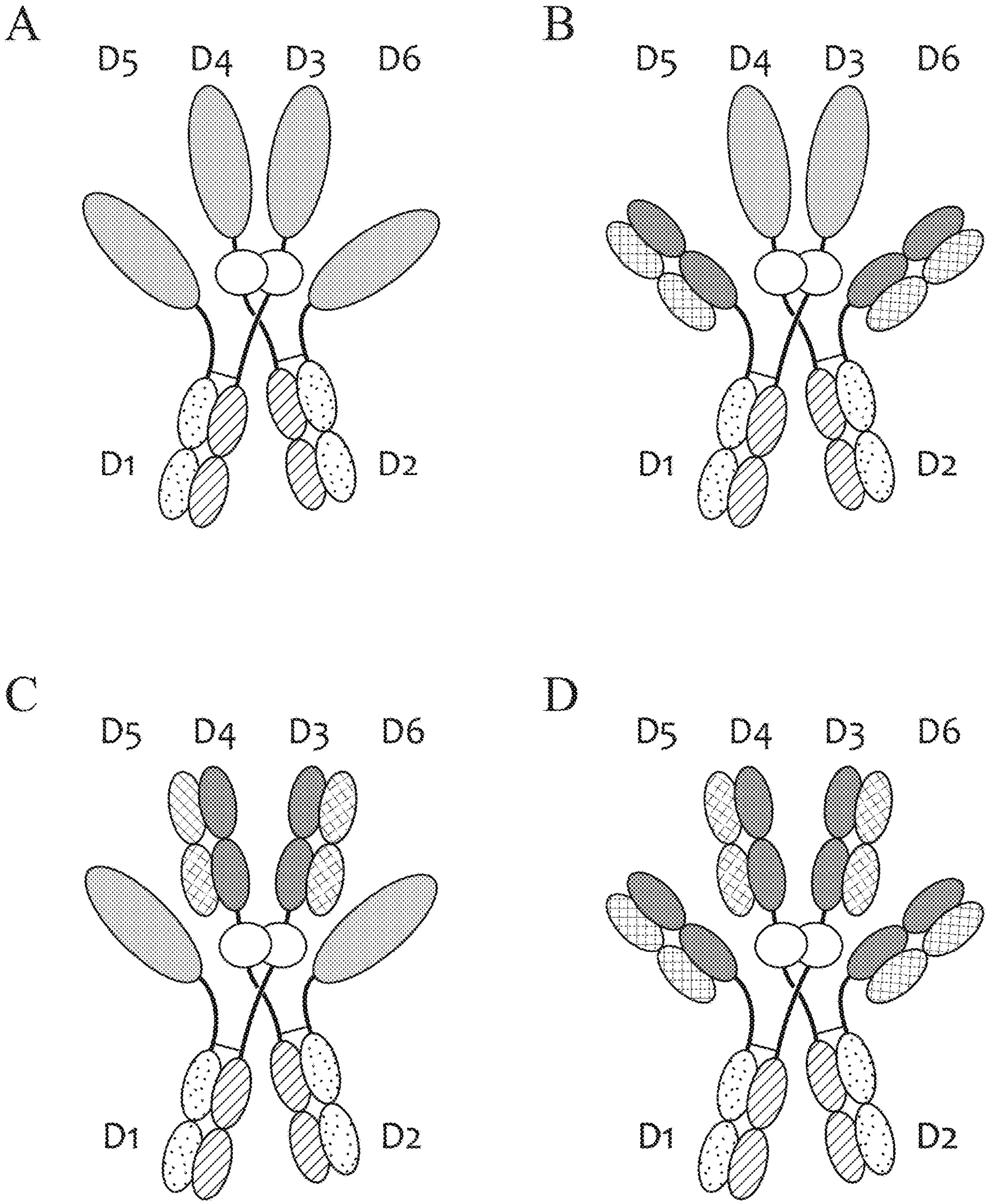
FIG. 31: Tetrahedral antibody comprising a first and second dimerizing polypeptide that form a homodimeric non-covalent linkage, wherein each of D1 and D2 is a heterodimeric Fc domain, and wherein (A) D3, D4, D5 and D6 specifically bind to a first target (tetravalent, monospecific), (B) D3 and D4 specifically bind to a first target, and D5 and D6 are Fab domains that specifically bind to a second target (tetravalent, 2+2 bispecific), (C) D3 and D4 are Fab domains that specifically bind to a first target, and D5 and D6 specifically bind to a second target (tetravalent, 2+2 bispecific), and (D) D3, D4, D5 and D6 are Fab domains that specifically bind to a first target (tetravalent, monospecific). The tetrahedral antibodies of A-D comprise (A) four chains: a first H1 chain [D1/D3], a second H1 chain [D2/D4], a first H2 chain [D1/D5], and second H2 chain [D2/D6], (B) six chains: a first H1 chain [D1/D3], a second H1 chain [D2/D4], a first H2 chain [D1/D5], a second H2 chain [D2/D6], a first L2 chain [D5], and a second L2 chain [D6], (C) six chains: a first H1 chain [D1/D3], a second H1 chain [D2/D4], a first H2 chain [D1/D5], a second H2 chain [D2/D6], a first L1 chain [D3], and a second L1 chain [D4], and (D) eight chains: a first H1 chain [D1/D3], a second H1 chain [D2/D4], a first H2 chain [D1/D5], a second H2 chain [D2/D6], a first L1 chain [D3], a second L1 chain [D4], a first L2 chain [D5], and a second L2 chain [D6].

In the above embodiment, the C-terminal portion of the H1 and H2 chains pair with one another to form each of domains 1 and 2, the N-terminal portion of the H1 chain is the ACE2 PD (domains 3 and 4), and the N-terminal portion of the H2 chain pairs with the L2 chain to form domains 5 and 6. Further, the H1 chain contains a CLD dimerizing domain between the portion that pairs with the H2 chain and the ACE2 PD. Panel B of FIG. 31 provides a schematic representation of the structure of such tetrahedral antibodies, where the chains in the schematic are, from left to right, L2, H2, H1, H1, H2, L2. This invention also provides a method of producing a tetrahedral antibody, the method comprising recombinantly expressing the three different types of polypeptide chains of this embodiment in a host cell.

In embodiments of the invention, the first and second domains are Fc domains, the third, fourth, fifth and sixth domains are each the ACE2 PD and the dimerizing polypeptides are each the ACE2 CLD, the first and second domains are each connected to their respective dimerizing polypeptides via a peptide linker, and the domains and peptide linkers of the tetrahedral antibody are formed by two different types of polypeptide chains. In a preferred embodiment, the two different types of polypeptide chains are denoted H1 and H2, and:

a) the H1 chain comprises the amino acid sequence set forth in SEQ ID NO: 509, and the H2 chain comprises the amino acid sequence set forth in SEQ ID NO: 510, or the H1 and H2 chains are variants with at least 90%, preferably at least 95%, more preferably at least 98% identity to said sequences;

b) the H1 chain comprises the amino acid sequence set forth in SEQ ID NO: 512, and the H2 chain comprises the amino acid sequence set forth in SEQ ID NO: 513 or the H1 and H2 chains are variants with at least 90%, preferably at least 95%, more preferably at least 98% identity to said sequences;

c) the H1 chain comprises the amino acid sequence set forth in SEQ ID NO: 516, and the H2 chain comprises the amino acid sequence set forth in SEQ ID NO: 517 or the H1 and H2 chains are variants with at least 90%, preferably at least 95%, more preferably at least 98% identity to said sequences;

d) the H1 chain comprises the amino acid sequence set forth in SEQ ID NO: 520, and the H2 chain comprises the amino acid sequence set forth in SEQ ID NO: 521 or the H1 and H2 chains are variants with at least 90%, preferably at least 95%, more preferably at least 98% identity to said sequences;

e) the H1 chain comprises the amino acid sequence set forth in SEQ ID NO: 542, and the H2 chain comprises the amino acid sequence set forth in SEQ ID NO: 543 or the H1 and H2 chains are variants with at least 90%, preferably at least 95%, more preferably at least 98% identity to said sequences;

f) the H1 chain comprises the amino acid sequence set forth in SEQ ID NO: 545, and the H2 chain comprises the amino acid sequence set forth in SEQ ID NO: 546 or the H1 and H2 chains are variants with at least 90%, preferably at least 95%, more preferably at least 98% identity to said sequences;

g) the H1 chain comprises the amino acid sequence set forth in SEQ ID NO: 548, and the H2 chain comprises the amino acid sequence set forth in SEQ ID NO: 549 or the H1 and H2 chains are variants with at least 90%, preferably at least 95%, more preferably at least 98% identity to said sequences; or h) the H1 chain comprises the amino acid sequence set forth in SEQ ID NO: 551, and the H2 chain comprises the amino acid sequence set forth in SEQ ID NO: 552 or the H1 and H2 chains are variants with at least 90%, preferably at least 95%, more preferably at least 98% identity to said sequences.

In the above embodiment, the C-terminal portion of the H1 and H2 chains pair with one another to form each of domains 1 and 2 and the N-terminal portions of the H1 and H2 chains are the ACE2 PD (domains 3-6). Further, the H1 chain contains a CLD dimerizing domain between the portion that pairs with the H2 chain and the ACE2 PD. Panel A of FIG. 31 provides a schematic representation of the structure of such tetrahedral antibodies, where the chains in the schematic are, from left to right, H2, H1, H1, H2. This invention also provides a method of producing a tetrahedral antibody, the method comprising recombinantly expressing the two different types of polypeptide chains of this embodiment in a host cell.

In embodiments of the invention:

a) the third domain, first dimerizing polypeptide, and first polypeptide chain of the first domain are part of a first stretch of consecutive amino acids, b) the fourth domain, second dimerizing polypeptide, and first polypeptide chain of the second domain are part of a second stretch of consecutive amino acids, c) the fifth domain, third dimerizing polypeptide, and second polypeptide chain of the first domain are part of a third stretch of consecutive amino acids, and d) the sixth domain, fourth dimerizing polypeptide, and second polypeptide chain of the second domain are part of a fourth stretch of consecutive amino acids, and each stretch of consecutive amino acids consists of the sequence of amino acids selected from the group consisting of SEQ ID NOs: 74-119, or each such stretch of consecutive amino acids are variants with at least 90%, preferably at least 95%, more preferably at least 98% identity to said sequences.

Polynucleotides

This invention also provides a polynucleotide which encodes any one of the polypeptide chains of the invention. In a preferred embodiment, the encoded polypeptide comprises the amino acid sequence set forth in any one of SEQ ID NOs: 74-119. In a preferred embodiment, the polynucleotide encodes one of the H1, L2, or H2 polypeptide chains of the embodiments described above. In a preferred embodiment, the polynucleotide encodes a stretch of consecutive amino acids consisting of the sequence of amino acids selected from the group consisting of SEQ ID NOs: 74-119 or a variant with at least 90%, preferably at least 95%, more preferably at least 98% identity to said sequences. As will be appreciated by those skilled in the art, polynucleotides of the invention may comprise various additional sequences depending on the type of expression system being employed. For example, mRNA polynucleotides of the invention may comprise 5' untranslated (UTR) and 3' untranslated (UTR) regions. Further, polynucleotides may encode signal peptide sequences for appropriate translocation of the expressed polypeptide. Therefore, without limitation, polynucleotides of the invention may include cis-regulatory elements such as promoters, enhancers, and/or introns, untranslated sequences such as 5' UTR and 3' UTR sequence, 5'caps or poly-A tails, and/or translated sequences such as signal peptide sequences. Without limitation, polynucleotides of the invention may comprise DNA or RNA, including mRNA, or modified versions thereof. Modified versions include versions that comprise non-standard nucleotides such as pseudouridine and the like.

Vectors

This invention also provides a vector comprising polynucleotides which encode polypeptides comprising any of the polypeptide chains of the invention. In a preferred embodiment, the vector encodes a polypeptide comprising the amino acid sequence set forth in any one of SEQ ID NOs: 74-119. In a preferred embodiment, the vector encodes polypeptides comprising the H1, L2 and H2 polypeptide chains of the embodiments of the invention comprising three different polypeptide chains as described above. In a preferred embodiment, the vector encodes polypeptides comprising the H1 and H2 polypeptide chains of the embodiments of the invention comprising two different polypeptide chains as described above. In these vectors, each polynucleotide is operably linked to a promoter which directs expression of the polynucleotide in a host cell. This invention also provides a method of producing a tetrahedral antibody, the method comprising recombinantly expressing any of these vectors in a host cell.

Host Cells

This invention also provides a host cell comprising any of the vectors of the invention. In a preferred embodiment, the host cell is for use in a method of producing a tetrahedral antibody. This invention also provides a method of producing a tetrahedral antibody comprising two, three, or four different types of polypeptide chains, the method comprising expressing the two, three, or four different types of polypeptide chains in a host cell of the invention.

Pharmaceutical Compositions

This invention also provides a pharmaceutical composition comprising any of the tetrahedral antibodies of the invention comprising one or more ACE2 PDs, and one or more pharmaceutically acceptable excipients.

In a preferred embodiment, the pharmaceutical composition comprises a tetrahedral antibody wherein the first and second domains are Fc domains, the third and fourth domains are the ACE2 PD, the fifth and sixth domains are Fab domains, the dimerizing polypeptides are each the ACE2 CLD, and the first and second domains are each connected to their respective dimerizing polypeptides via a peptide linker, wherein the domains and peptide linkers of the tetrahedral antibody are formed by three different types of polypeptide chains. In a preferred embodiment the three different types of polypeptide chains are denoted H1, L2, and H2, and:

a) the H1 chain comprises the amino acid sequence set forth in SEQ ID NO: 524, the L2 chain comprises the amino acid sequence set forth in SEQ ID NO: 465, and the H2 chain comprises the amino acid sequence set forth in SEQ ID NO: 535, or the H1, L2 and H2 chains are variants with at least 90%, preferably at least 95%, more preferably at least 98% identity to said sequences;

b) the H1 chain comprises the amino acid sequence set forth in SEQ ID NO: 473, the L2 chain comprises the amino acid sequence set forth in SEQ ID NO: 465, and the H2 chain comprises the amino acid sequence set forth in SEQ ID NO: 485, or the H1, L2 and H2 chains are variants with at least 90%, preferably at least 95%, more preferably at least 98% identity to said sequences;

c) the H1 chain comprises the amino acid sequence set forth in SEQ ID NO: 526, the L2 chain comprises the amino acid sequence set forth in SEQ ID NO: 465, and the H2 chain comprises the amino acid sequence set forth in SEQ ID NO: 527, or the H1, L2 and H2 chains are variants with at least 90%, preferably at least 95%, more preferably at least 98% identity to said sequences;

d) the H1 chain comprises the amino acid sequence set forth in SEQ ID NO: 514, the L2 chain comprises the amino acid sequence set forth in SEQ ID NO: 465, and the H2 chain comprises the amino acid sequence set forth in SEQ ID NO: 528, or the H1, L2 and H2 chains are variants with at least 90%, preferably at least 95%, more preferably at least 98% identity to said sequences;

e) the H1 chain comprises the amino acid sequence set forth in SEQ ID NO: 529, the L2 chain comprises the amino acid sequence set forth in SEQ ID NO: 465, and the H2 chain comprises the amino acid sequence set forth in SEQ ID NO: 530, or the H1, L2 and H2 chains are variants with at least 90%, preferably at least 95%, more preferably at least 98% identity to said sequences;

f) the H1 chain comprises the amino acid sequence set forth in SEQ ID NO: 518, the L2 chain comprises the amino acid sequence set forth in SEQ ID NO: 465, and the H2 chain comprises the amino acid sequence set forth in SEQ ID NO: 531; or the H1, L2 and H2 chains are variants with at least 90%, preferably at least 95%, more preferably at least 98% identity to said sequences, g) the H1 chain comprises the amino acid sequence set forth in SEQ ID NO: 532, the L2 chain comprises the amino acid sequence set forth in SEQ ID NO: 465, and the H2 chain comprises the amino acid sequence set forth in SEQ ID NO: 533, or the H1, L2 and H2 chains are variants with at least 90%, preferably at least 95%, more preferably at least 98% identity to said sequences; or h) the H1 chain comprises the amino acid sequence set forth in SEQ ID NO: 522, the L2 chain comprises the amino acid sequence set forth in SEQ ID NO: 465, and the H2 chain comprises the amino acid sequence set forth in SEQ ID NO: 534, or the H1, L2 and H2 chains are variants with at least 90%, preferably at least 95%, more preferably at least 98% identity to said sequences.

In a preferred embodiment, the pharmaceutical composition comprises a tetrahedral antibody wherein the first and second domains are Fc domains, the third, fourth, fifth and sixth domains are each the ACE2 PD and the dimerizing polypeptides are each the ACE2 CLD, the first and second domains are each connected to their respective dimerizing polypeptides via a peptide linker, and the domains and peptide linkers of the tetrahedral antibody are formed by two different types of polypeptide chains. In a preferred embodiment, the two different types of polypeptide chains are denoted H1 and H2, and:

a) the H1 chain comprises the amino acid sequence set forth in SEQ ID NO: 509, and the H2 chain comprises the amino acid sequence set forth in SEQ ID NO: 510, or the H1 and H2 chains are variants with at least 90%, preferably at least 95%, more preferably at least 98% identity to said sequences;

b) the H1 chain comprises the amino acid sequence set forth in SEQ ID NO: 512, and the H2 chain comprises the amino acid sequence set forth in SEQ ID NO: 513 or the H1 and H2 chains are variants with at least 90%, preferably at least 95%, more preferably at least 98% identity to said sequences;

c) the H1 chain comprises the amino acid sequence set forth in SEQ ID NO: 516, and the H2 chain comprises the amino acid sequence set forth in SEQ ID NO: 517 or the H1 and H2 chains are variants with at least 90%, preferably at least 95%, more preferably at least 98% identity to said sequences;

d) the H1 chain comprises the amino acid sequence set forth in SEQ ID NO: 520, and the H2 chain comprises the amino acid sequence set forth in SEQ ID NO: 521 or the H1 and H2 chains are variants with at least 90%, preferably at least 95%, more preferably at least 98% identity to said sequences;

e) the H1 chain comprises the amino acid sequence set forth in SEQ ID NO: 542, and the H2 chain comprises the amino acid sequence set forth in SEQ ID NO: 543 or the H1 and H2 chains are variants with at least 90%, preferably at least 95%, more preferably at least 98% identity to said sequences;

f) the H1 chain comprises the amino acid sequence set forth in SEQ ID NO: 545, and the H2 chain comprises the amino acid sequence set forth in SEQ ID NO: 546 or the H1 and H2 chains are variants with at least 90%, preferably at least 95%, more preferably at least 98% identity to said sequences;

g) the H1 chain comprises the amino acid sequence set forth in SEQ ID NO: 548, and the H2 chain comprises the amino acid sequence set forth in SEQ ID NO: 549 or the H1 and H2 chains are variants with at least 90%, preferably at least 95%, more preferably at least 98% identity to said sequences; or h) the H1 chain comprises the amino acid sequence set forth in SEQ ID NO: 551, and the H2 chain comprises the amino acid sequence set forth in SEQ ID NO: 552 or the H1 and H2 chains are variants with at least 90%, preferably at least 95%, more preferably at least 98% identity to said sequences.

Methods of Treating

This invention also provides a method of treating Covid-19 in a subject, the method comprising administering to the subject a therapeutically effective amount of the any of the above pharmaceutical compositions comprising a tetrahedral antibody comprising one or more ACE2 PD.

Tetrahedral Antibodies Comprising a Seventh and/or Eighth Domain

In embodiments of the invention, the tetrahedral antibody further comprises a seventh and/or eight domain, wherein:

a) the first domain is joined to the second domain via a covalent linkage attached to the first N-terminus of the first domain or via a first dimerizing polypeptide attached to the first N-terminus of the first domain, and wherein
   i) the seventh domain is attached at its N-terminus by a peptide bond or via a peptide linker to:
      (1) the first C-terminus of the first domain, or
      (2) the second C-terminus of the first domain, b) the first domain is joined to the second domain via a covalent linkage attached to the first C-terminus of the first domain or via a first dimerizing polypeptide attached to the first C-terminus of the first domain, and wherein
   i) the seventh domain is attached at its C-terminus by a peptide bond or via a peptide linker to:
      (1) the first N-terminus of the first domain, or
      (2) the second N-terminus of the first domain, c) the second domain is joined to the first domain via a covalent linkage attached to the first N-terminus of the second domain or via a second dimerizing polypeptide attached to the first N-terminus of the second domain, and wherein
   i) the eighth domain is attached at its N-terminus by a peptide bond or via a peptide linker to:
      (1) the first C-terminus of the second domain, or
      (2) the second C-terminus of the second domain, or d) the second domain is joined to the first domain via a covalent linkage attached to the first C-terminus of the second domain or via a second dimerizing polypeptide attached to the first C-terminus of the second domain, and wherein
   i) the eighth domain is attached at its C-terminus by a peptide bond or via a peptide linker to:
      (1) the first N-terminus of the second domain, or
      (2) the second N-terminus of the second domain.

Tetrahedral Antibodies for Cancer Treatment

In embodiments of the invention, the tetrahedral antibody comprises six domains, and:

a) the first and second domains are Fc domains, the third and fourth domains are anti-CD20 Fab domains and the fifth and sixth domains are anti-CD19 Fab domains;

b) the first and second domains are Fc domains, the third and fourth domains are anti-CD19 Fab domains and the fifth and sixth domains are anti-CD20 Fab domains;

c) the first and second domains are Fc domains, the third and fourth domains are anti-CD20 Fab domains, the fifth and sixth domains are anti-CD19 Fab domains, and each dimerizing polypeptide is an ACE2 CLD;

d) the first and second domains are Fc domains, the third and fourth domains are anti-CD19 Fab domains and the fifth and sixth domains are anti-CD20 Fab domains, and each dimerizing polypeptide is an ACE2 CLD;

e) the first and second domains are Fc domains, the third and fourth domains are anti-CD20 Fab domains, the fifth and sixth domains are anti-CD19 Fab domains, each dimerizing polypeptide is an ACE2 CLD, and the first and second domains are each connected to their respective dimerizing polypeptides via a peptide linker;

f) the first and second domains are Fc domains, the third and fourth domains are anti-CD19 Fab domains and the fifth and sixth domains are anti-CD20 Fab domains, each dimerizing polypeptide is an ACE2 CLD, and the first and second domains are each connected to their respective dimerizing polypeptides via a peptide linker.

In embodiments of the invention, the tetrahedral antibody comprises eight domains, and:

a) the first and second domains are Fc domains, the third and fourth domains are anti-CD20 Fab domains and the fifth and sixth domains are anti-CD19 Fab domains, and the seventh and eighth domains are single chain 4-1BB ligands;

b) the first and second domains are Fc domains, the third and fourth domains are anti-CD19 Fab domains, the fifth and sixth domains are anti-CD20 Fab domains, and the seventh and eighth domains are single chain 4-1BB ligands;

c) the first and second domains are Fc domains, the third and fourth domains are anti-CD20 Fab domains, the fifth and sixth domains are anti-CD19 Fab domains, the seventh and eighth domains are single chain 4-1BB ligands, and each dimerizing polypeptide is an ACE2 CLD;

d) the first and second domains are Fc domains, the third and fourth domains are anti-CD19 Fab domains and the fifth and sixth domains are anti-CD20 Fab domains, the seventh and eighth domains are single chain 4-1BB ligands, and each dimerizing polypeptide is an ACE2 CLD;

e) the first and second domains are Fc domains, the third and fourth domains are anti-CD20 Fab domains, the fifth and sixth domains are anti-CD19 Fab domains, the seventh and eighth domains are single chain 4-1BB ligands, each dimerizing polypeptide is an ACE2 CLD, and the first and second domains are each connected to their respective dimerizing polypeptides via a peptide linker; or f) the first and second domains are Fc domains, the third and fourth domains are anti-CD19 Fab domains and the fifth and sixth domains are anti-CD20 Fab domains, the seventh and eighth domains are single chain 4-1BB ligands, each dimerizing polypeptide is an ACE2 CLD, and the first and second domains are each connected to their respective dimerizing polypeptides via a peptide linker.

In embodiments of the invention:

a) the anti-CD19 Fab domain comprises:
  i) the CDRs of each of the heavy and lights chains of FMC63, preferably wherein the anti-CD19 Fab is the Fab domain of FMC63;
  ii) the CDRs of each of the heavy and lights chains of FMC60, preferably wherein the anti-CD19 Fab is the Fab domain of FMC60; or
  iii) the CDRs of each of the heavy and lights chains of FMC59, preferably wherein the anti-CD19 Fab is the Fab domain of FMC59; and/or b) the anti-CD20 Fab domain comprises the CDR of rituximab, preferably wherein the anti-CD20 Fab is the Fab domain of rituximab.

In embodiments of the invention the Fc domains are characterized by one or more or all of the following features:

a) are heterodimers, b) are IgG1 Fc domains, c) comprise a silencing mutation such that the Fc domain lacks Fc gamma receptor binding activity, preferably wherein such mutation is one of the following combinations of mutations:
  i) P329G/L234A/L235A (PGLALA),
  ii) L234A/L235A (LALA),
  iii) P331S/L234A/L235A,
  iv) L234F/L235E/P331S, and
  v) L234F/L235E/P329G, d) comprise a mutation that enhances FcRn activity, preferably wherein such mutation extends the half-life of the tetrahedral antibody, preferably wherein the mutation is a combination the following mutations: L309D/Q311H/N434S (DHS), e) comprise a mutation that enhances Fc gamma receptor binding activity, preferably wherein the mutation is:
  i) a combination of the following mutations: S239D/I332E,
  ii) S239D, preferably wherein the other polypeptide chain of the Fc domain comprises a I332E mutation, or
  iii) I332E, preferably wherein the other polypeptide chain of the Fc domain comprises a S239D mutation, and f) comprise a mutation that ablates their Protein A binding site, preferably wherein such mutation is H435R/Y436F (HY/RF).

In embodiments of the invention, the peptide linkers each have a length of 23 amino acids and are derived from the stalk region of a TNF receptor, preferably wherein the TNF receptor is TNF receptor 1B, still more preferably wherein the peptide linker consists of the amino acid sequence set forth in SEQ ID NO: 4468, and In embodiments of the invention, the dimerizing polypeptides are each an ACE2 CLD, and wherein each ACE2 CLD comprises or consists of amino acids 616-740 of the ACE2 protein.

In embodiments of the invention comprising six domains, wherein such domains and peptide linkers are formed by four different types of polypeptide chains, preferably the four different types of polypeptide chains are denoted L1, H1, L2, and H2, and:

a) the L1 chain comprises the amino acid sequence set forth in SEQ ID NO: 733, the H1 chain comprises the amino acid sequence set forth in SEQ ID NO: 707, the L2 chain comprises the amino acid sequence set forth in SEQ ID NO: 734, and the H2 chain comprises the amino acid sequence set forth in SEQ ID NO: 708, or wherein the L1, H1, L2, and H2 chains are variants with at least 90%, preferably at least 95%, more preferably at least 98% identity to said sequences;

b) the L1 chain comprises the amino acid sequence set forth in SEQ ID NO: 735, the H1 chain comprises the amino acid sequence set forth in SEQ ID NO: 709, the L2 chain comprises the amino acid sequence set forth in SEQ ID NO: 736, and the H2 chain comprises the amino acid sequence set forth in SEQ ID NO: 710, or wherein the L1, H1, L2, and H2 chains are variants with at least 90%, preferably at least 95%, more preferably at least 98% identity to said sequences;

c) the L1 chain comprises the amino acid sequence set forth in SEQ ID NO: 735, the H1 chain comprises the amino acid sequence set forth in SEQ ID NO: 709, the L2 chain comprises the amino acid sequence set forth in SEQ ID NO: 737, and the H2 chain comprises the amino acid sequence set forth in SEQ ID NO: 711, or wherein the L1, H1, L2, and H2 chains are variants with at least 90%, preferably at least 95%, more preferably at least 98% identity to said sequences;

d) the L1 chain comprises the amino acid sequence set forth in SEQ ID NO: 738, the H1 chain comprises the amino acid sequence set forth in SEQ ID NO: 712, the L2 chain comprises the amino acid sequence set forth in SEQ ID NO: 739, and the H2 chain comprises the amino acid sequence set forth in SEQ ID NO: 713, or wherein the L1, H1, L2, and H2 chains are variants with at least 90%, preferably at least 95%, more preferably at least 98% identity to said sequences;

e) the L1 chain comprises the amino acid sequence set forth in SEQ ID NO: 740, the H1 chain comprises the amino acid sequence set forth in SEQ ID NO: 714, the L2 chain comprises the amino acid sequence set forth in SEQ ID NO: 741, and the H2 chain comprises the amino acid sequence set forth in SEQ ID NO: 715, or wherein the L1, H1, L2, and H2 chains are variants with at least 90%, preferably at least 95%, more preferably at least 98% identity to said sequences;

f) the L1 chain comprises the amino acid sequence set forth in SEQ ID NO: 740, the H1 chain comprises the amino acid sequence set forth in SEQ ID NO: 714, the L2 chain comprises the amino acid sequence set forth in SEQ ID NO: 742, and the H2 chain comprises the amino acid sequence set forth in SEQ ID NO: 716, or wherein the L1, H1, L2, and H2 chains are variants with at least 90%, preferably at least 95%, more preferably at least 98% identity to said sequences;

g) the L1 chain comprises the amino acid sequence set forth in SEQ ID NO: 4801, the H1 chain comprises the amino acid sequence set forth in SEQ ID NO: 4721, the L2 chain comprises the amino acid sequence set forth in SEQ ID NO: 4802, and the H2 chain comprises the amino acid sequence set forth in SEQ ID NO: 4722, or wherein the L1, H1, L2, and H2 chains are variants with at least 90%, preferably at least 95%, more preferably at least 98% identity to said sequences;

h) the L1 chain comprises the amino acid sequence set forth in SEQ ID NO: 4803, the H1 chain comprises the amino acid sequence set forth in SEQ ID NO: 4723, the L2 chain comprises the amino acid sequence set forth in SEQ ID NO: 4804, and the H2 chain comprises the amino acid sequence set forth in SEQ ID NO: 4724, or wherein the L1, H1, L2, and H2 chains are variants with at least 90%, preferably at least 95%, more preferably at least 98% identity to said sequences;

i) the L1 chain comprises the amino acid sequence set forth in SEQ ID NO: 4803, the H1 chain comprises the amino acid sequence set forth in SEQ ID NO: 4723, the L2 chain comprises the amino acid sequence set forth in SEQ ID NO: 4805, and the H2 chain comprises the amino acid sequence set forth in SEQ ID NO: 4725, or wherein the L1, H1, L2, and H2 chains are variants with at least 90%, preferably at least 95%, more preferably at least 98% identity to said sequences;

j) the L1 chain comprises the amino acid sequence set forth in SEQ ID NO: 4806, the H1 chain comprises the amino acid sequence set forth in SEQ ID NO: 4726, the L2 chain comprises the amino acid sequence set forth in SEQ ID NO: 4807, and the H2 chain comprises the amino acid sequence set forth in SEQ ID NO: 4727, or wherein the L1, H1, L2, and H2 chains are variants with at least 90%, preferably at least 95%, more preferably at least 98% identity to said sequences;

k) the L1 chain comprises the amino acid sequence set forth in SEQ ID NO: 4808, the H1 chain comprises the amino acid sequence set forth in SEQ ID NO: 4728, the L2 chain comprises the amino acid sequence set forth in SEQ ID NO: 4809, and the H2 chain comprises the amino acid sequence set forth in SEQ ID NO: 4729, or wherein the L1, H1, L2, and H2 chains are variants with at least 90%, preferably at least 95%, more preferably at least 98% identity to said sequences;

l) the L1 chain comprises the amino acid sequence set forth in SEQ ID NO: 4808, the H1 chain comprises the amino acid sequence set forth in SEQ ID NO: 4728, the L2 chain comprises the amino acid sequence set forth in SEQ ID NO: 4810, and the H2 chain comprises the amino acid sequence set forth in SEQ ID NO: 4730, or wherein the L1, H1, L2, and H2 chains are variants with at least 90%, preferably at least 95%, more preferably at least 98% identity to said sequences;

m) the L1 chain comprises the amino acid sequence set forth in SEQ ID NO: 4803, the H1 chain comprises the amino acid sequence set forth in SEQ ID NO: 4723, the L2 chain comprises the amino acid sequence set forth in SEQ ID NO: 4813, and the H2 chain comprises the amino acid sequence set forth in SEQ ID NO: 4772, or wherein the L1, H1, L2, and H2 chains are variants with at least 90%, preferably at least 95%, more preferably at least 98% identity to said sequences;

n) the L1 chain comprises the amino acid sequence set forth in SEQ ID NO: 4803, the H1 chain comprises the amino acid sequence set forth in SEQ ID NO: 4723, the L2 chain comprises the amino acid sequence set forth in SEQ ID NO: 4814, and the H2 chain comprises the amino acid sequence set forth in SEQ ID NO: 4773, or wherein the L1, H1, L2, and H2 chains are variants with at least 90%, preferably at least 95%, more preferably at least 98% identity to said sequences;

o) the L1 chain comprises the amino acid sequence set forth in SEQ ID NO: 4815, the H1 chain comprises the amino acid sequence set forth in SEQ ID NO: 4774, the L2 chain comprises the amino acid sequence set forth in SEQ ID NO: 4813, and the H2 chain comprises the amino acid sequence set forth in SEQ ID NO: 4772, or wherein the L1, H1, L2, and H2 chains are variants with at least 90%, preferably at least 95%, more preferably at least 98% identity to said sequences;

p) the L1 chain comprises the amino acid sequence set forth in SEQ ID NO: 4815, the H1 chain comprises the amino acid sequence set forth in SEQ ID NO: 4774, the L2 chain comprises the amino acid sequence set forth in SEQ ID NO: 4814, and the H2 chain comprises the amino acid sequence set forth in SEQ ID NO: 4773, or wherein the L1, H1, L2, and H2 chains are variants with at least 90%, preferably at least 95%, more preferably at least 98% identity to said sequences;

q) the L1 chain comprises the amino acid sequence set forth in SEQ ID NO: 4816, the H1 chain comprises the amino acid sequence set forth in SEQ ID NO: 4775, the L2 chain comprises the amino acid sequence set forth in SEQ ID NO: 4809, and the H2 chain comprises the amino acid sequence set forth in SEQ ID NO: 4729, or wherein the L1, H1, L2, and H2 chains are variants with at least 90%, preferably at least 95%, more preferably at least 98% identity to said sequences;

r) the L1 chain comprises the amino acid sequence set forth in SEQ ID NO: 4816, the H1 chain comprises the amino acid sequence set forth in SEQ ID NO: 4775, the L2 chain comprises the amino acid sequence set forth in SEQ ID NO: 4810, and the H2 chain comprises the amino acid sequence set forth in SEQ ID NO: 4730, or wherein the L1, H1, L2, and H2 chains are variants with at least 90%, preferably at least 95%, more preferably at least 98% identity to said sequences;

s) the L1 chain comprises the amino acid sequence set forth in SEQ ID NO: 4817, the H1 chain comprises the amino acid sequence set forth in SEQ ID NO: 4776, the L2 chain comprises the amino acid sequence set forth in SEQ ID NO: 4809, and the H2 chain comprises the amino acid sequence set forth in SEQ ID NO: 4729, or wherein the L1, H1, L2, and H2 chains are variants with at least 90%, preferably at least 95%, more preferably at least 98% identity to said sequences;

t) the L1 chain comprises the amino acid sequence set forth in SEQ ID NO: 4817, the H1 chain comprises the amino acid sequence set forth in SEQ ID NO: 4776, the L2 chain comprises the amino acid sequence set forth in SEQ ID NO: 4810, and the H2 chain comprises the amino acid sequence set forth in SEQ ID NO: 4730, or wherein the L1, H1, L2, and H2 chains are variants with at least 90%, preferably at least 95%, more preferably at least 98% identity to said sequences;

u) the L1 chain comprises the amino acid sequence set forth in SEQ ID NO: 4803, the H1 chain comprises the amino acid sequence set forth in SEQ ID NO: 4723, the L2 chain comprises the amino acid sequence set forth in SEQ ID NO: 4814, and the H2 chain comprises the amino acid sequence set forth in SEQ ID NO: 4794, or wherein the L1, H1, L2, and H2 chains are variants with at least 90%, preferably at least 95%, more preferably at least 98% identity to said sequences;

v) the L1 chain comprises the amino acid sequence set forth in SEQ ID NO: 4815, the H1 chain comprises the amino acid sequence set forth in SEQ ID NO: 4774, the L2 chain comprises the amino acid sequence set forth in SEQ ID NO: 4813, and the H2 chain comprises the amino acid sequence set forth in SEQ ID NO: 4793, or wherein the L1, H1, L2, and H2 chains are variants with at least 90%, preferably at least 95%, more preferably at least 98% identity to said sequences;

w) the L1 chain comprises the amino acid sequence set forth in SEQ ID NO: 4815, the H1 chain comprises the amino acid sequence set forth in SEQ ID NO: 4774, the L2 chain comprises the amino acid sequence set forth in SEQ ID NO: 4814, and the H2 chain comprises the amino acid sequence set forth in SEQ ID NO: 4794, or wherein the L1, H1, L2, and H2 chains are variants with at least 90%, preferably at least 95%, more preferably at least 98% identity to said sequences;

x) the L1 chain comprises the amino acid sequence set forth in SEQ ID NO: 4819, the H1 chain comprises the amino acid sequence set forth in SEQ ID NO: 4775, the L2 chain comprises the amino acid sequence set forth in SEQ ID NO: 4809, and the H2 chain comprises the amino acid sequence set forth in SEQ ID NO: 4729, or wherein the L1, H1, L2, and H2 chains are variants with at least 90%, preferably at least 95%, more preferably at least 98% identity to said sequences y) the L1 chain comprises the amino acid sequence set forth in SEQ ID NO: 4819, the H1 chain comprises the amino acid sequence set forth in SEQ ID NO: 4775, the L2 chain comprises the amino acid sequence set forth in SEQ ID NO: 4810, and the H2 chain comprises the amino acid sequence set forth in SEQ ID NO: 4730, or wherein the L1, H1, L2, and H2 chains are variants with at least 90%, preferably at least 95%, more preferably at least 98% identity to said sequences;

z) the L1 chain comprises the amino acid sequence set forth in SEQ ID NO: 4820, the H1 chain comprises the amino acid sequence set forth in SEQ ID NO: 4776, the L2 chain comprises the amino acid sequence set forth in SEQ ID NO: 4809, and the H2 chain comprises the amino acid sequence set forth in SEQ ID NO: 4729, or wherein the L1, H1, L2, and H2 chains are variants with at least 90%, preferably at least 95%, more preferably at least 98% identity to said sequences; or aa) the L1 chain comprises the amino acid sequence set forth in SEQ ID NO: 4820, the H1 chain comprises the amino acid sequence set forth in SEQ ID NO: 4776, the L2 chain comprises the amino acid sequence set forth in SEQ ID NO: 4810, and the H2 chain comprises the amino acid sequence set forth in SEQ ID NO: 4730, or wherein the L1, H1, L2, and H2 chains are variants with at least 90%, preferably at least 95%, more preferably at least 98% identity to said sequences.

In another embodiment of the invention comprising six domains, wherein such domains and peptide linkers are formed by four different types of polypeptide chains, the polypeptides are any of those listed in Table 54, preferably protein IDs 21-31 to 21-38 and 21-69 to 21-76.

In the above embodiment, the C-terminal portion of the H1 and H2 chains pair with one another to form each of domains 1 and 2, The N-terminal portion of the H1 chain pairs with L1 chains to form the third and fourth domains and the N-terminal portion of the H2 chain pairs with L2 to form the fifth and sixth domains Further, the H1 chain contains a CLD dimerizing domain between the portion that pairs with the H2 chain and the portion that pairs with the L1 chain. Panels C and D of FIG. 31 provide schematic representations of the structure of such tetrahedral antibodies, where the chains in the schematic are, from left to right, L2, H2, L1, H1, H1, L1, H2, L2. This invention provides a method of producing a tetrahedral antibody, the method comprising recombinantly expressing the four different types of polypeptide chains of this embodiment in a host cell.

In embodiments of the invention comprising eight domains, wherein such domains and peptide linkers are formed by four different types of polypeptide chains, preferably the four different types of polypeptide chains are denoted L1, H1, L2, and H2, and:

a) the L1 chain comprises the amino acid sequence set forth in SEQ ID NO: 733, the L2 chain comprises the amino acid sequence set forth in SEQ ID NO: 734, and the H2 chain comprises the amino acid sequence set forth in SEQ ID NO: 717, or wherein the L1, H1, L2, and H2 chains are variants with at least 90%, preferably at least 95%, more preferably at least 98% identity to said sequences;

b) the L1 chain comprises the amino acid sequence set forth in SEQ ID NO: 735, the H1 chain comprises the amino acid sequence set forth in SEQ ID NO: 709, the L2 chain comprises the amino acid sequence set forth in SEQ ID NO: 736, and the H2 chain comprises the amino acid sequence set forth in SEQ ID NO: 718, or wherein the L1, H1, L2, and H2 chains are variants with at least 90%, preferably at least 95%, more preferably at least 98% identity to said sequences;

c) the L1 chain comprises the amino acid sequence set forth in SEQ ID NO: 735, the H1 chain comprises the amino acid sequence set forth in SEQ ID NO: 709, the L2 chain comprises the amino acid sequence set forth in SEQ ID NO: 737, and the H2 chain comprises the amino acid sequence set forth in SEQ ID NO: 719, or wherein the L1, H1, L2, and H2 chains are variants with at least 90%, preferably at least 95%, more preferably at least 98% identity to said sequences;

d) the L1 chain comprises the amino acid sequence set forth in SEQ ID NO: 738, the H1 chain comprises the amino acid sequence set forth in SEQ ID NO: 712, the L2 chain comprises the amino acid sequence set forth in SEQ ID NO: 739, and the H2 chain comprises the amino acid sequence set forth in SEQ ID NO: 720, or wherein the L1, H1, L2, and H2 chains are variants with at least 90%, preferably at least 95%, more preferably at least 98% identity to said sequences;

e) the L1 chain comprises the amino acid sequence set forth in SEQ ID NO: 740, the H1 chain comprises the amino acid sequence set forth in SEQ ID NO: 714, the L2 chain comprises the amino acid sequence set forth in SEQ ID NO: 741, and the H2 chain comprises the amino acid sequence set forth in SEQ ID NO: 721, or wherein the L1, H1, L2, and H2 chains are variants with at least 90%, preferably at least 95%, more preferably at least 98% identity to said sequences;

f) the L1 chain comprises the amino acid sequence set forth in SEQ ID NO: 740, the H1 chain comprises the amino acid sequence set forth in SEQ ID NO: 714, the L2 chain comprises the amino acid sequence set forth in SEQ ID NO: 742, and the H2 chain comprises the amino acid sequence set forth in SEQ ID NO: 722, or wherein the L1, H1, L2, and H2 chains are variants with at least 90%, preferably at least 95%, more preferably at least 98% identity to said sequences;

g) the L1 chain comprises the amino acid sequence set forth in SEQ ID NO: 733, the H1 chain comprises the amino acid sequence set forth in SEQ ID NO: 723, the L2 chain comprises the amino acid sequence set forth in SEQ ID NO: 734, and the H2 chain comprises the amino acid sequence set forth in SEQ ID NO: 724, or wherein the L1, H1, L2, and H2 chains are variants with at least 90%, preferably at least 95%, more preferably at least 98% identity to said sequences;

h) the L1 chain comprises the amino acid sequence set forth in SEQ ID NO: 735, the H1 chain comprises the amino acid sequence set forth in SEQ ID NO: 725, the L2 chain comprises the amino acid sequence set forth in SEQ ID NO: 736, and the H2 chain comprises the amino acid sequence set forth in SEQ ID NO: 726, or wherein the L1, H1, L2, and H2 chains are variants with at least 90%, preferably at least 95%, more preferably at least 98% identity to said sequences;

i) the L1 chain comprises the amino acid sequence set forth in SEQ ID NO: 735, the H1 chain comprises the amino acid sequence set forth in SEQ ID NO: 725, the L2 chain comprises the amino acid sequence set forth in SEQ ID NO: 737, and the H2 chain comprises the amino acid sequence set forth in SEQ ID NO: 727, or wherein the L1, H1, L2, and H2 chains are variants with at least 90%, preferably at least 95%, more preferably at least 98% identity to said sequences;

j) the L1 chain comprises the amino acid sequence set forth in SEQ ID NO: 738, the H1 chain comprises the amino acid sequence set forth in SEQ ID NO: 728, the L2 chain comprises the amino acid sequence set forth in SEQ ID NO: 739, and the H2 chain comprises the amino acid sequence set forth in SEQ ID NO: 729, or wherein the L1, H1, L2, and H2 chains are variants with at least 90%, preferably at least 95%, more preferably at least 98% identity to said sequences;

k) the L1 chain comprises the amino acid sequence set forth in SEQ ID NO: 740, the H1 chain comprises the amino acid sequence set forth in SEQ ID NO: 730, the L2 chain comprises the amino acid sequence set forth in SEQ ID NO: 741, and the H2 chain comprises the amino acid sequence set forth in SEQ ID NO: 731, or wherein the L1, H1, L2, and H2 chains are variants with at least 90%, preferably at least 95%, more preferably at least 98% identity to said sequences; or l) the L1 chain comprises the amino acid sequence set forth in SEQ ID NO: 740, the H1 chain comprises the amino acid sequence set forth in SEQ ID NO: 730, the L2 chain comprises the amino acid sequence set forth in SEQ ID NO: 742, and the H2 chain comprises the amino acid sequence set forth in SEQ ID NO: 732, or wherein the L1, H1, L2, and H2 chains are variants with at least 90%, preferably at least 95%, more preferably at least 98% identity to said sequences.

Figure 37:
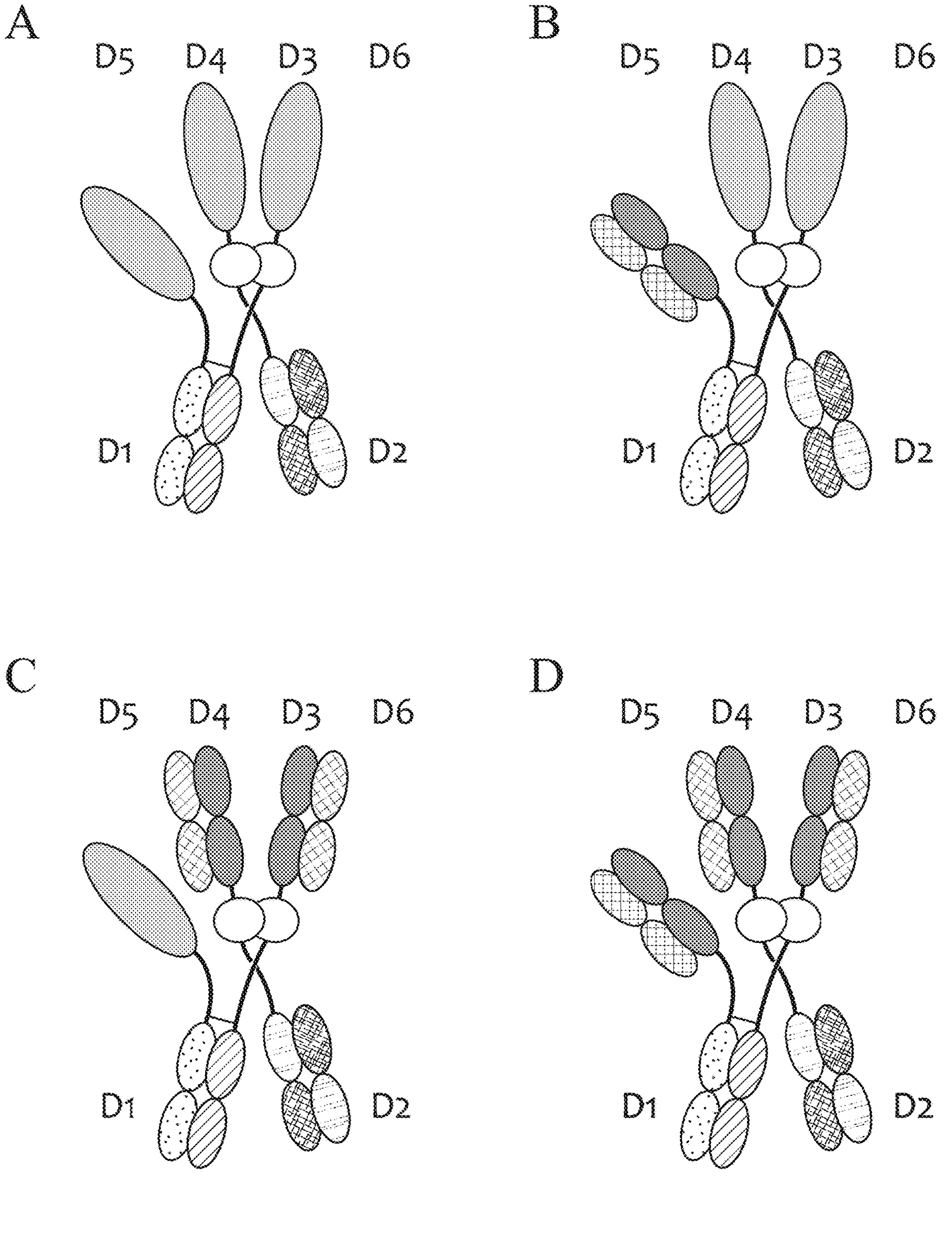
FIG. 37: Tetrahedral antibody comprising a first and second dimerizing polypeptide that form a homodimeric non-covalent linkage, wherein D1 is a heterodimeric Fc domain and D2 is a Fab domain, and wherein (A) D2 is a variable region exchanged Fab that binds to a first target, and D3, D4 and D5 specifically bind to a second target (tetravalent, 3+1 bispecific), (B) D2 is a variable region exchanged Fab that binds to a first target, D3 and D4 specifically bind to a second target, and D5 is a Fab that specifically bind to a third target (tetravalent, 2+1+1 trispecific), (C) D2 is a variable region exchanged Fab that binds to a first target, D3 and D4 are Fab domains that specifically bind to a second target, and D5 specifically binds to a third target (tetravalent, 2+1+1 trispecific), and (D) D2 is a variable region exchanged Fab that binds to a first target, D3, D4, and D5 are Fab domains that specifically bind to a second target (tetravalent, 3+1 bispecific). The tetrahedral antibodies of A-D comprise (A) four chains: a first H1 chain [D1/D3], a first H1Fab chain [D2/D4], a first H2 chain [D1/D5], and a first Fab chain [D2], (B) five chains: a first H1 chain [D1/D3], a first H1Fab chain [D2/D4], a first H2 chain [D1/D5], a first Fab chain [D2], and a first L2 chain [D5], (C) six chains: a first H1 chain [D1/D3], a first H1Fab chain [D2/D4], a first H2 chain [D1/D5], a first Fab chain [D2], a first L1 chain [D3], and a second L1 chain [D4], and (D) seven chains: a first H1 chain [D1/D3], a first H1Fab chain [D2/D4], a first H2 chain [D1/D5], a first Fab chain [D2], a first L1/L2 chain [D3], a second L1/L2 chain [D4], and a third L1/L2 chain [D5].
Figure 38:
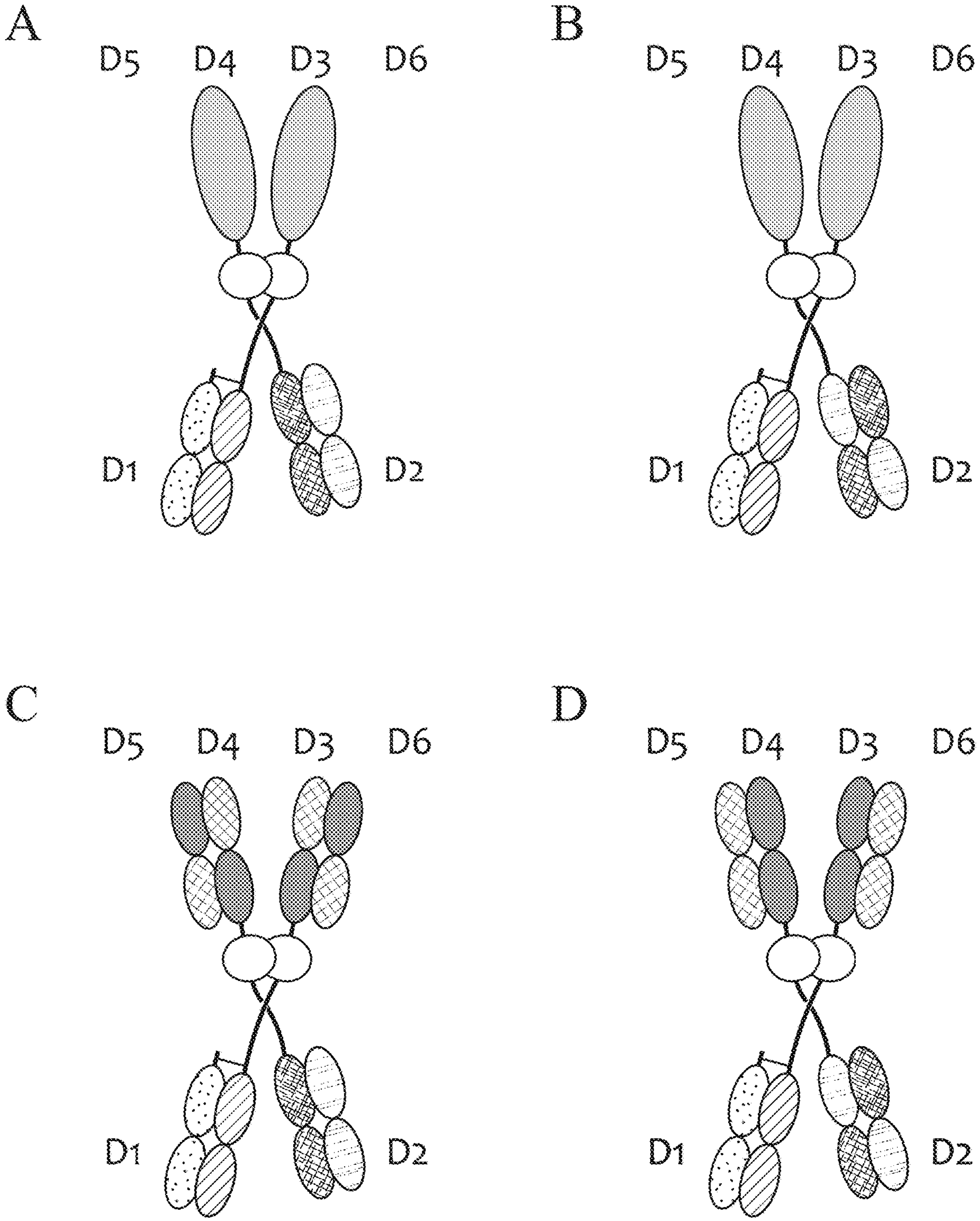
FIG. 38: Tetrahedral antibody comprising a first and second dimerizing polypeptide that form a homodimeric non-covalent linkage, wherein D1 is a heterodimeric Fc domain and D2 is a Fab domain, and wherein (A) D2 is a Fab that binds to a first target, and D3 and D4 specifically bind to a second target (trivalent, 2+1 bispecific), (B) D2 is a variable region exchanged Fab that binds to a first target, and D3 and D4 specifically bind to a second target, (C) D2 is a Fab that binds to a first target, and D3 and D4 are variable region exchanged Fab domains that specifically bind to a second target (trivalent, 2+1 bispecific), and (D) D2 is a variable region exchanged Fab that binds to a first target, D3 and D4 are Fab domains that specifically bind to a second target (trivalent, 2+1 bispecific). The tetrahedral antibodies of A-D comprise (A) four chains: a first H1 chain [D1/D3], a first H1Fab chain [D2/D4], a first Fc chain [D1], and a first Fab chain [D2], (B) four chains: a first H1 chain [D1/D3], a first H1Fab chain [D2/D4], a first Fc chain [D1], and a first Fab chain [D2], (C) six chains: a first H1 chain [D1/D3], a first H1Fab chain [D2/D4], a first Fc chain [D1], a first Fab chain [D2], a first L1 chain [D3], and a second L1 chain [D4], and (D) six chains: a first H1 chain [D1/D3], a first H1Fab chain [D2/D4], a first Fc chain [D1], a first Fab chain [D2], a first L1 chain [D3], and a second L1 chain [D4].
Figure 39:
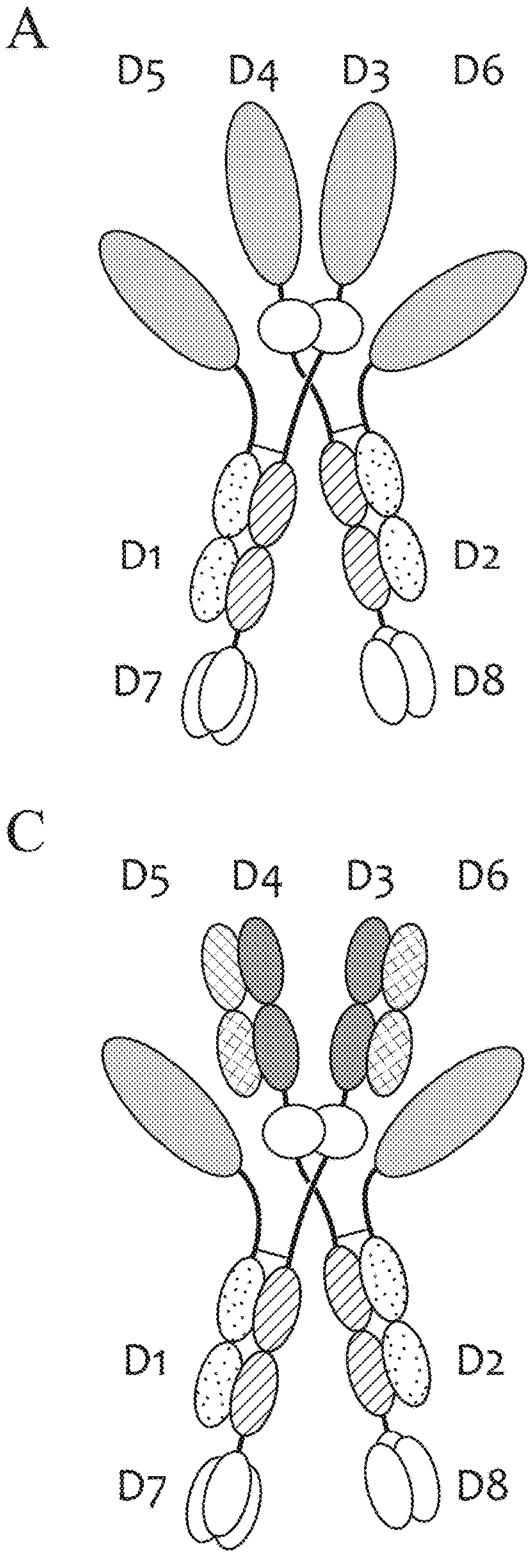
FIG. 39: Tetrahedral antibody comprising a first and second dimerizing polypeptide that form a homodimeric non-covalent linkage, wherein each of D1 and D2 is a heterodimeric Fc domain, and wherein (A) D3, D4, D5 and D6 specifically bind to a first target, and D7 and D8 specifically bind to a second target (hexavalent, 4+2 bispecific), (B) D3 and D4 specifically bind to a first target, D5 and D6 are Fab domains that specifically bind to a second target, and D7 and D8 specifically bind to a third target (hexavalent, 2+2+2 trispecific), (C) D3 and D4 are Fab domains that specifically bind to a first target, D5 and D6 specifically bind to a second target, and D7 and D8 specifically bind to a third target (hexavalent, 2+2+2 trispecific), and (D) D3, D4, D5 and D6 are Fab domains that specifically bind to a first target, and D7 and D8 specifically bind to a second target (hexavalent, 4+2 bispecific). The tetrahedral antibodies of A-D comprise (A) four chains: a first H1 chain [D1/D3/D7], a second H1 chain [D2/D4/D8], a first H2 chain [D1/D5], and second H2 chain [D2/D6], (B) six chains: a first H1 chain [D1/D3/D7], a second H1 chain [D2/D4/D8], a first H2 chain [D1/D5], a second H2 chain [D2/D6], a first L2 chain [D5], and a second L2 chain [D6], (C) six chains: a first H1 chain [D1/D3/D7], a second H1 chain [D2/D4/D8], a first H2 chain [D1/D5], a second H2 chain [D2/D6], a first L1 chain [D3], and a second L1 chain [D4], and [D] eight chains: a first H1 chain [D1/D3/D7], a second H1 chain [D2/D4/D8], a first H2 chain [D1/D5], a second H2 chain [D2/D6], a first L1 chain [D3], a second L1 chain [D4], a first L2 chain [D5], and a second L2 chain [D6]. D7 and D8 may be attached at the C-termini of the first and second H1 chains (as shown), or the C-termini of the first and second H2 chains. D7 and D8 are depicted as a single-chain TNFSF ligand fusion polypeptides but may be any domain.
Figure 40:
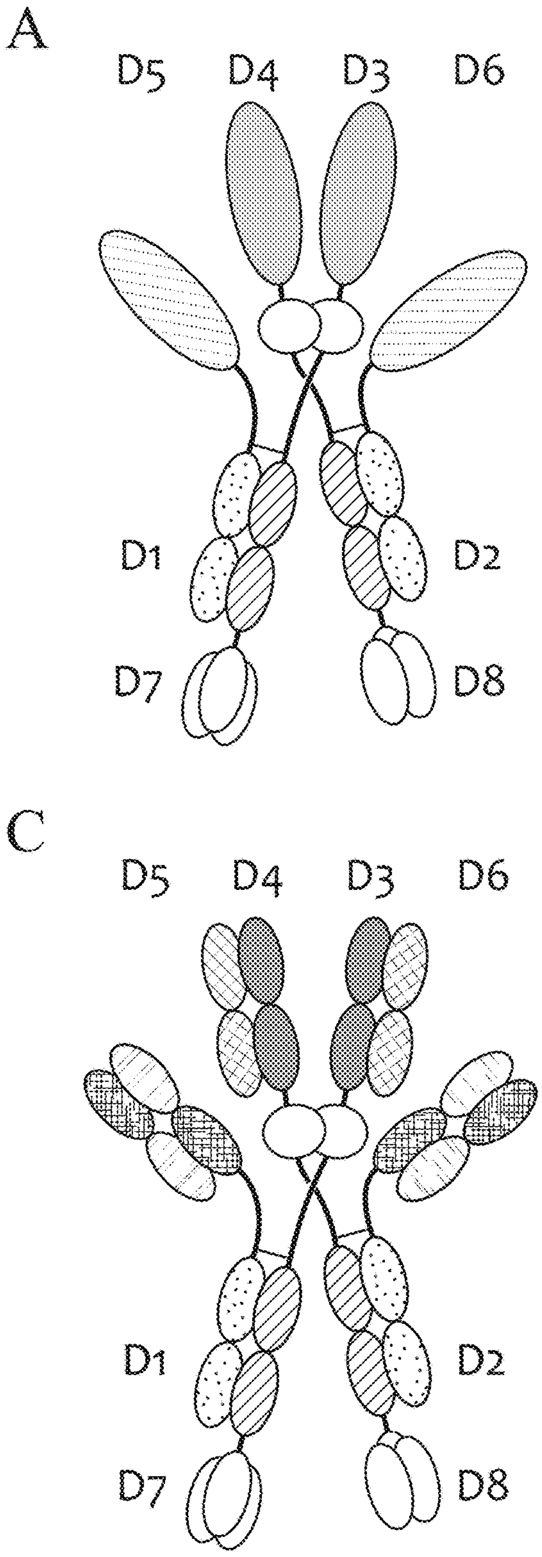
FIG. 40: Tetrahedral antibody comprising a first and second dimerizing polypeptide that form a homodimeric non-covalent linkage, wherein each of D1 and D2 is a heterodimeric Fc domain, and wherein (A) D3 and D4 specifically bind to a first target, D5 and D6 specifically bind to a second target, and D7 and D8 specifically bind to a third target (hexavalent, 2+2+2 trispecific), (B) D5 and D6 specifically bind to a first target, D3 and D4 specifically bind to a second target, and D7 and D8 specifically bind to a third target (hexavalent, 2+2+2 trispecific), (C) D3 and D4 are Fab domains that specifically bind to a first target, D5 and D6 are variable region exchanged Fab domains that specifically bind to a second target, and D7 and D8 specifically bind to a third target (hexavalent, 2+2+2 trispecific), and (D) D5 and D6 are Fab domains that specifically bind to a first target, D3 and D4 are variable region exchanged Fab domains that specifically bind to a second target, and D7 and D8 specifically bind to a third target (hexavalent, 2+2+2 trispecific). The tetrahedral antibodies of A-D comprise (A) four chains: a first H1 chain [D1/D3/D7], a second H1 chain [D2/D4/D8], a first H2 chain [D1/D5], and a second H2 chain [D2/D6], (B) four chains: a first H1 chain [D1/D3/D7], a second H1 chain [D2/D4/D8], a first H2 chain [D1/D5], and a second H2 chain [D2/D6], (C) eight chains: a first H1 chain [D1/D3/D7], a second H1 chain [D2/D4/D8], a first H2 chain [D1/D5], a second H2 chain [D2/D6], a first L1 chain [D3], a second L1 chain [D4], a first L2 chain [D5], and a second L2 chain [D6], and (D) eight chains: a first H1 chain [D1/D3/D7], a second H1 chain [D2/D4/D8], a first H2 chain [D1/D5], a second H2 chain [D2/D6], a first L1 chain [D3], a second L1 chain [D4], a first L2 chain [D5], and a second L2 chain [D6]. D7 and D8 may be attached at the C-termini of the first and second H1 chains (as shown), or the C-termini of the first and second H2 chains. D7 and D8 are depicted as a single-chain TNFSF ligand fusion polypeptides but may be any domain.
Figure 41:
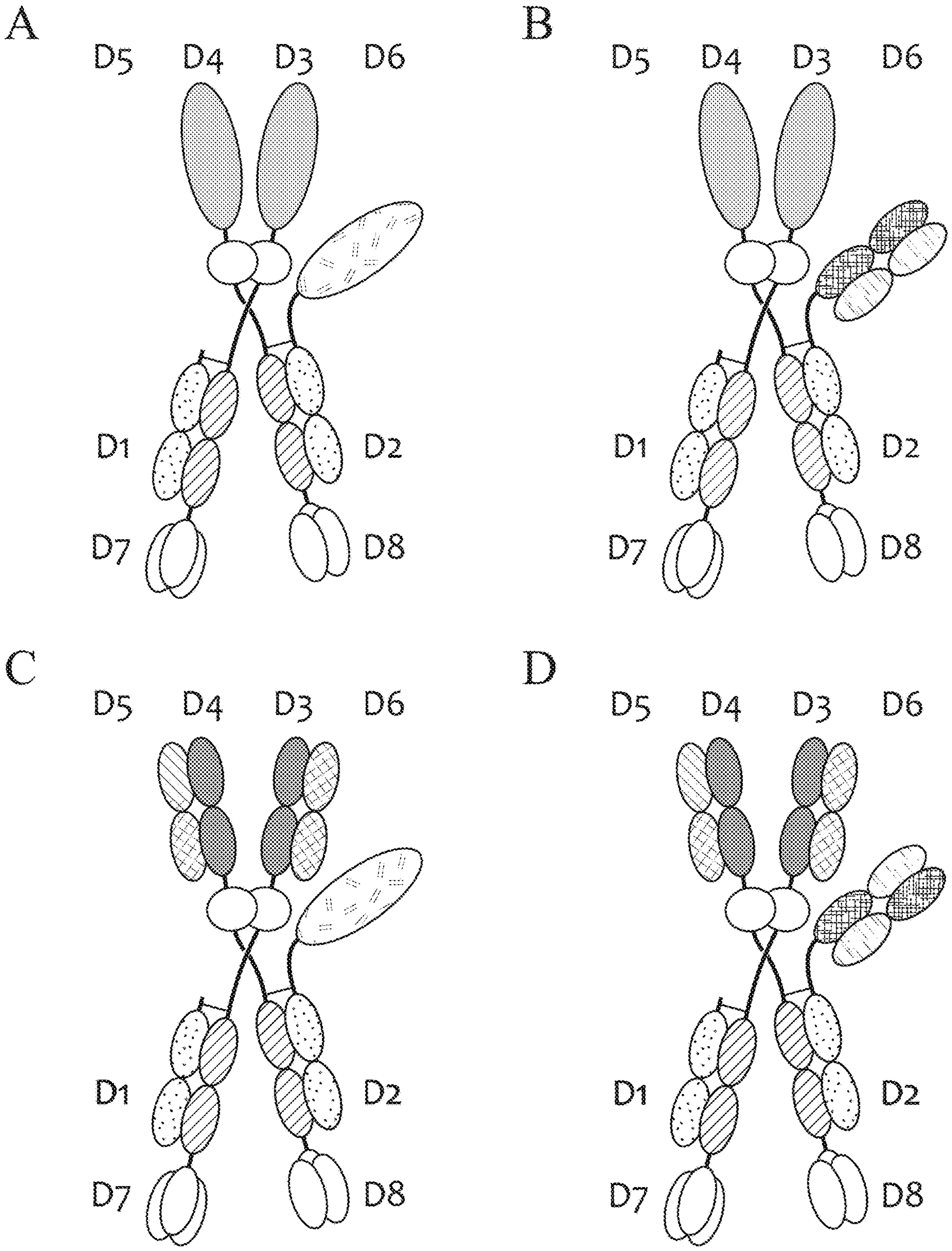
FIG. 41: Tetrahedral antibody comprising a first and second dimerizing polypeptide that form a homodimeric non-covalent linkage, wherein each of D1 and D2 is a heterodimeric Fc domain, and wherein (A) D3 and D4 specifically bind to a first target, D6 specifically binds to a second target, and D7 and D8 specifically bind to a third target (pentavalent, 2+2+1 trispecific), (B) D3 and D4 specifically bind to a first target, D6 is a Fab domain that specifically binds to a second target, and D7 and D8 specifically bind to a third target (pentavalent, 2+2+1 trispecific), (C) D3 and D4 are Fab domains that specifically bind to a first target, D6 specifically binds to a second target, and D7 and D8 specifically bind to a third target (pentavalent, 2+2+1 trispecific), and (D) D3 and D4 are Fab domains that specifically bind to a first target, D6 is a variable region exchanged Fab domain that specifically binds to a second target, and D7 and D8 specifically bind to a third target (pentavalent, 2+2+1 trispecific). The tetrahedral antibodies of A-D comprise (A) four chains: a first H1 chain [D1/D3/D7], a second H1 chain [D2/D4/D8], a first H2 chain [D2/D6], and a first Fc chain [D1], (B) five chains: a first H1 chain [D1/D3/D7], a second H1 chain [D2/D4/D8], a first H2 chain [D2/D6], an Fc chain [D1] and an L2 chain [D6], (C) six chains: a first H1 chain [D1/D3/D7], a second H1 chain [D2/D4/D8], a first H2 chain [D2/D6], a first Fc chain [D1], a first L1 chain [D3], and a second L1 chain [D4], and (D) seven chains: a first H1 chain [D1/D3/D7], a second H1 chain [D2/D4/D8], a first H2 chain [D2/D6], a first Fc chain [D1], a first L1 chain [D3], a second L1 chain [D4], and a first L2 chain [D6]. D7 and D8 may be attached at the C-termini of the first and second H1 chains (as shown), or the C-termini of the first and second H2 chains. D7 and D8 are depicted as a single-chain TNFSF ligand fusion polypeptides but may be any domain.
Figure 42:
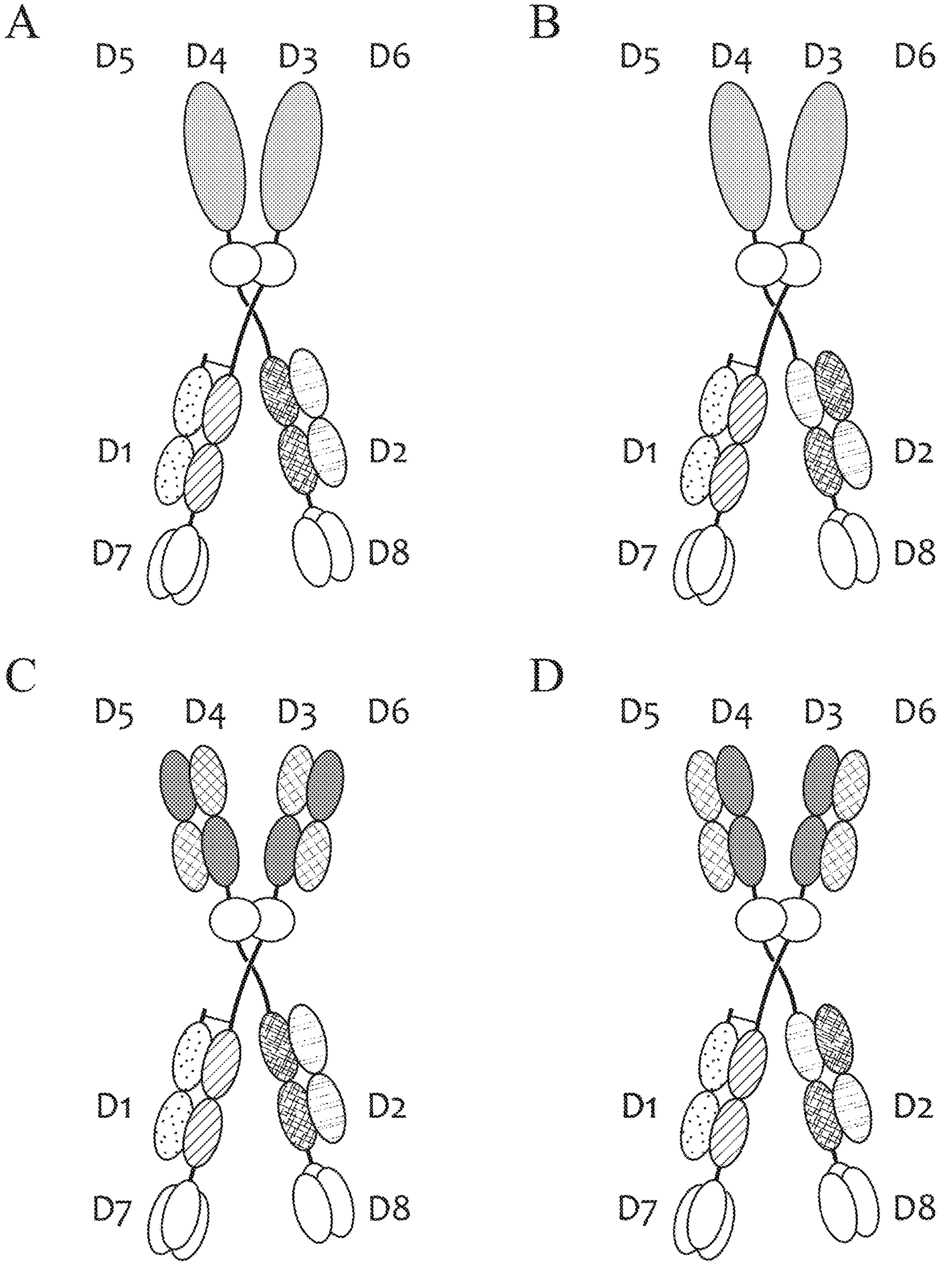
FIG. 42: Tetrahedral antibody comprising a first and second dimerizing polypeptide that form a homodimeric non-covalent linkage, wherein D1 is a heterodimeric Fc domain and D2 is a Fab domain, and wherein (A) D2 is a Fab domain that specifically binds to a first target, D3 and D4 specifically bind to a second target, and D7 and D8 specifically bind to a third target (pentavalent, 2+2+1 trispecific), (B) D2 is a variable region exchanged Fab domain that specifically binds to a first target, D3 and D4 specifically bind to a second target, and D7 and D8 specifically bind to a third target (pentavalent, 2+2+1 trispecific), (C) D2 is a Fab domain that specifically binds to a first target, D3 and D4 are variable region exchanged Fab domains that specifically bind to a second target, and D7 and D8 specifically bind to a third target (pentavalent, 2+2+1 trispecific), and (D) D2 is a variable region exchanged Fab domain that specifically binds to a first target, D3 and D4 are Fab domains that specifically bind to a second target, and D7 and D8 specifically bind to a third target (pentavalent, 2+2+1 trispecific). The tetrahedral antibodies of A-D comprise (A) four chains: a first H1 chain [D1/D3/D7], a second H1 chain [D2/D4/D8], a first Fc chain [D1], and a first Fab chain [D2]. (B) four chains: a first H1 chain [D1/D3/D7], a second H1 chain [D2/D4/D8], a first Fc chain [D1], and a first Fab chain [D2]. (C) six chains: a first H1 chain [D1/D3/D7], a second H1 chain [D2/D4/D8], a first Fc chain [D1], a first Fab chain [D2], a first L1 chain [D3], and a second L1 chain [D4], and (D) six chains: a first H1 chain [D1/D3/D7], a second H1 chain [D2/D4/D8], a first H2 chain [D2/D6], a first Fc chain [D1], a first Fab chain [D2], a first L1 chain [D3], and a second L1 chain [D4]. D7 and D8 may be attached at the C-termini of the first and second H1 chains (as shown), or the C-termini of the first and second H2 chains. D7 and D8 are depicted as a single-chain TNFSF ligand fusion polypeptides but may be any domain.

In the above embodiment, the C-terminal portion of the H1 chain forms domains 7 and 8, while the C-terminal portion of the H2 chain pairs with part of the H1 chain to form each of domains 1 and 2, The N-terminal portion of the H1 chain pairs with L1 chains to form the third and fourth domains and the N-terminal portion of the H2 chain pairs with L2 to form the fifth and sixth domains Further, the H1 chain contains a CLD dimerizing domain between the portion that pairs with the H2 chain and the portion that pairs with the L1 chain. Panels D of FIG. 37 provides schematic representations of the structure of such tetrahedral antibodies, where the chains in the schematic are, from left to right, L2, H2, L1, H1, H1, L1, H2, L2. This invention provides a method of producing a tetrahedral antibody, the method comprising recombinantly expressing the four different types of polypeptide chains of this embodiment in a host cell.

Polynucleotides

This invention also provides a polynucleotide which encodes a polypeptide comprising any one of the polypeptide chains of the above embodiments. In a preferred embodiment, the polynucleotide encodes one of the L1, H1, L2, and H2 polypeptide chains of the embodiments described above.

Vectors

This invention also provides a vector comprising polynucleotides which encode polypeptides comprising any of the polypeptide chains of the invention. In a preferred embodiment, the vector encodes polypeptides comprising the L1, H1, L2, and H2 polypeptide chains of the embodiments of the invention comprising four different polypeptide chains as described above. In these vectors, each polynucleotide is operably linked to a promoter which directs expression of the polynucleotide in a host cell. This invention also provides a method of producing a tetrahedral antibody, the method comprising recombinantly expressing any of these vectors in a host cell.

Host Cells

This invention also provides a host cell comprising any of the vectors of the invention. In a preferred embodiment, the host cell is for use in a method of producing a tetrahedral antibody. This invention also provides a method of producing a tetrahedral antibody comprising four different types of polypeptide chains, the method comprising expressing four different types of polypeptide chains in a host cell of the invention as described in the above embodiments.

Pharmaceutical Compositions

This invention also provides a pharmaceutical composition comprising any of the tetrahedral antibodies of the invention comprising anti-CD20 and/or anti-CD19 Fab domains, and one or more pharmaceutically acceptable excipients.

In a preferred embodiment, the pharmaceutical composition comprises a tetrahedral antibody comprising six domains, wherein such domains and peptide linkers are formed by four different types of polypeptide chains, preferably the four different types of polypeptide chains are denoted L1, H1, L2, and H2, and:

a) the L1 chain comprises the amino acid sequence set forth in SEQ ID NO: 733, the H1 chain comprises the amino acid sequence set forth in SEQ ID NO: 707, the L2 chain comprises the amino acid sequence set forth in SEQ ID NO: 734, and the H2 chain comprises the amino acid sequence set forth in SEQ ID NO: 708, or wherein the L1, H1, L2, and H2 chains are variants with at least 90%, preferably at least 95%, more preferably at least 98% identity to said sequences;

b) the L1 chain comprises the amino acid sequence set forth in SEQ ID NO: 735, the H1 chain comprises the amino acid sequence set forth in SEQ ID NO: 709, the L2 chain comprises the amino acid sequence set forth in SEQ ID NO: 736, and the H2 chain comprises the amino acid sequence set forth in SEQ ID NO: 710, or wherein the L1, H1, L2, and H2 chains are variants with at least 90%, preferably at least 95%, more preferably at least 98% identity to said sequences;

c) the L1 chain comprises the amino acid sequence set forth in SEQ ID NO: 735, the H1 chain comprises the amino acid sequence set forth in SEQ ID NO: 709, the L2 chain comprises the amino acid sequence set forth in SEQ ID NO: 737, and the H2 chain comprises the amino acid sequence set forth in SEQ ID NO: 711, or wherein the L1, H1, L2, and H2 chains are variants with at least 90%, preferably at least 95%, more preferably at least 98% identity to said sequences;

d) the L1 chain comprises the amino acid sequence set forth in SEQ ID NO: 738, the H1 chain comprises the amino acid sequence set forth in SEQ ID NO: 712, the L2 chain comprises the amino acid sequence set forth in SEQ ID NO: 739, and the H2 chain comprises the amino acid sequence set forth in SEQ ID NO: 713, or wherein the L1, H1, L2, and H2 chains are variants with at least 90%, preferably at least 95%, more preferably at least 98% identity to said sequences;

e) the L1 chain comprises the amino acid sequence set forth in SEQ ID NO: 740, the H1 chain comprises the amino acid sequence set forth in SEQ ID NO: 714, the L2 chain comprises the amino acid sequence set forth in SEQ ID NO: 741, and the H2 chain comprises the amino acid sequence set forth in SEQ ID NO: 715, or wherein the L1, H1, L2, and H2 chains are variants with at least 90%, preferably at least 95%, more preferably at least 98% identity to said sequences; or f) the L1 chain comprises the amino acid sequence set forth in SEQ ID NO: 740, the H1 chain comprises the amino acid sequence set forth in SEQ ID NO: 714, the L2 chain comprises the amino acid sequence set forth in SEQ ID NO: 742, and the H2 chain comprises the amino acid sequence set forth in SEQ ID NO: 716, or wherein the L1, H1, L2, and H2 chains are variants with at least 90%, preferably at least 95%, more preferably at least 98% identity to said sequences.

In a preferred embodiment, the pharmaceutical composition comprises a tetrahedral antibody comprising eight domains, wherein such domains and peptide linkers are formed by four different types of polypeptide chains, preferably the four different types of polypeptide chains are denoted L1, H1, L2, and H2, and:

a) the L1 chain comprises the amino acid sequence set forth in SEQ ID NO: 733, the H1 chain comprises the amino acid sequence set forth in SEQ ID NO: 707, the L2 chain comprises the amino acid sequence set forth in SEQ ID NO: 734, and the H2 chain comprises the amino acid sequence set forth in SEQ ID NO: 717, or wherein the L1, H1, L2, and H2 chains are variants with at least 90%, preferably at least 95%, more preferably at least 98% identity to said sequences;

b) the L1 chain comprises the amino acid sequence set forth in SEQ ID NO: 735, the H1 chain comprises the amino acid sequence set forth in SEQ ID NO: 709, the L2 chain comprises the amino acid sequence set forth in SEQ ID NO: 736, and the H2 chain comprises the amino acid sequence set forth in SEQ ID NO: 718, or wherein the L1, H1, L2, and H2 chains are variants with at least 90%, preferably at least 95%, more preferably at least 98% identity to said sequences;

c) the L1 chain comprises the amino acid sequence set forth in SEQ ID NO: 735, the H1 chain comprises the amino acid sequence set forth in SEQ ID NO: 709, the L2 chain comprises the amino acid sequence set forth in SEQ ID NO: 737, and the H2 chain comprises the amino acid sequence set forth in SEQ ID NO: 719, or wherein the L1, H1, L2, and H2 chains are variants with at least 90%, preferably at least 95%, more preferably at least 98% identity to said sequences;

d) the L1 chain comprises the amino acid sequence set forth in SEQ ID NO: 738, the H1 chain comprises the amino acid sequence set forth in SEQ ID NO: 712, the L2 chain comprises the amino acid sequence set forth in SEQ ID NO: 739, and the H2 chain comprises the amino acid sequence set forth in SEQ ID NO: 720, or wherein the L1, H1, L2, and H2 chains are variants with at least 90%, preferably at least 95%, more preferably at least 98% identity to said sequences;

e) the L1 chain comprises the amino acid sequence set forth in SEQ ID NO: 740, the H1 chain comprises the amino acid sequence set forth in SEQ ID NO: 714, the L2 chain comprises the amino acid sequence set forth in SEQ ID NO: 741, and the H2 chain comprises the amino acid sequence set forth in SEQ ID NO: 721, or wherein the L1, H1, L2, and H2 chains are variants with at least 90%, preferably at least 95%, more preferably at least 98% identity to said sequences;

f) the L1 chain comprises the amino acid sequence set forth in SEQ ID NO: 740, the H1 chain comprises the amino acid sequence set forth in SEQ ID NO: 714, the L2 chain comprises the amino acid sequence set forth in SEQ ID NO: 742, and the H2 chain comprises the amino acid sequence set forth in SEQ ID NO: 722, or wherein the L1, H1, L2, and H2 chains are variants with at least 90%, preferably at least 95%, more preferably at least 98% identity to said sequences;

g) the L1 chain comprises the amino acid sequence set forth in SEQ ID NO: 733, the H1 chain comprises the amino acid sequence set forth in SEQ ID NO: 723, the L2 chain comprises the amino acid sequence set forth in SEQ ID NO: 734, and the H2 chain comprises the amino acid sequence set forth in SEQ ID NO: 724, or wherein the L1, H1, L2, and H2 chains are variants with at least 90%, preferably at least 95%, more preferably at least 98% identity to said sequences;

h) the L1 chain comprises the amino acid sequence set forth in SEQ ID NO: 735, the H1 chain comprises the amino acid sequence set forth in SEQ ID NO: 725, the L2 chain comprises the amino acid sequence set forth in SEQ ID NO: 736, and the H2 chain comprises the amino acid sequence set forth in SEQ ID NO: 726, or wherein the L1, H1, L2, and H2 chains are variants with at least 90%, preferably at least 95%, more preferably at least 98% identity to said sequences;

i) the L1 chain comprises the amino acid sequence set forth in SEQ ID NO: 735, the H1 chain comprises the amino acid sequence set forth in SEQ ID NO: 725, the L2 chain comprises the amino acid sequence set forth in SEQ ID NO: 737, and the H2 chain comprises the amino acid sequence set forth in SEQ ID NO: 727, or wherein the L1, H1, L2, and H2 chains are variants with at least 90%, preferably at least 95%, more preferably at least 98% identity to said sequences;

j) the L1 chain comprises the amino acid sequence set forth in SEQ ID NO: 738, the H1 chain comprises the amino acid sequence set forth in SEQ ID NO: 728, the L2 chain comprises the amino acid sequence set forth in SEQ ID NO: 739, and the H2 chain comprises the amino acid sequence set forth in SEQ ID NO: 729, or wherein the L1, H1, L2, and H2 chains are variants with at least 90%, preferably at least 95%, more preferably at least 98% identity to said sequences;

k) the L1 chain comprises the amino acid sequence set forth in SEQ ID NO: 740, the H1 chain comprises the amino acid sequence set forth in SEQ ID NO: 730, the L2 chain comprises the amino acid sequence set forth in SEQ ID NO: 741, and the H2 chain comprises the amino acid sequence set forth in SEQ ID NO: 731, or wherein the L1, H1, L2, and H2 chains are variants with at least 90%, preferably at least 95%, more preferably at least 98% identity to said sequences; or l) the L1 chain comprises the amino acid sequence set forth in SEQ ID NO: 740, the H1 chain comprises the amino acid sequence set forth in SEQ ID NO: 730, the L2 chain comprises the amino acid sequence set forth in SEQ ID NO: 742, and the H2 chain comprises the amino acid sequence set forth in SEQ ID NO: 732, or wherein the L1, H1, L2, and H2 chains are variants with at least 90%, preferably at least 95%, more preferably at least 98% identity to said sequences.

Method of Treating

This invention also provides a method of treating cancer or inflammatory disease in a subject, the method comprising administering to the subject a therapeutically effective amount of the any of the above pharmaceutical compositions comprising a tetrahedral antibody comprising anti-CD20 and/or anti-CD19 Fab domains, preferably wherein the cancer is B cell cancer.

Tetrahedral Molecules

This invention also provides a tetrahedral molecule comprising a first, second, third, and fourth domain, wherein:

a) the first and second domains each independently comprise:
   i) a first polypeptide chain comprising a first N-terminus and a first C-terminus of the domain, and
   ii) optionally a second polypeptide chain comprising a second N-terminus and a second C-terminus of the domain, b) the first domain and the second domain are joined to each other by a non-covalent linkage
   (1) between a first dimerizing polypeptide attached by a peptide bond or via a peptide linker to the first N-terminus of the first domain, and a second dimerizing polypeptide attached by a peptide bond or via a peptide linker to the first N-terminus of the second domain,
   (2) between a first dimerizing polypeptide attached by a peptide bond or via a peptide linker to the first C-terminus of the first domain, and a second dimerizing polypeptide attached by a peptide bond or via a peptide linker to the first C-terminus of the second domain,
   (3) between a first dimerizing polypeptide attached by a peptide bond or via a peptide linker to the first N-terminus of the first domain, and a second dimerizing polypeptide attached by a peptide bond or via a peptide linker to the first C-terminus of the second domain, or
   (4) between a first dimerizing polypeptide attached by a peptide bond or via a peptide linker to the first C-terminus of the first domain, and a second dimerizing polypeptide attached by a peptide bond or via a peptide linker to the first N-terminus of the second domain, wherein the first and second dimerizing polypeptides are not immunoglobulin polypeptides, c) if the first domain is joined to the second domain via a first dimerizing polypeptide attached to the first N-terminus of the first domain, then the third domain is attached at its C-terminus by a peptide bond or via a peptide linker to
   i) the N-terminus of the first dimerizing polypeptide,
   ii) the second N-terminus of the first domain if present, or
   iii) the N-terminus of a third dimerizing polypeptide, wherein the third dimerizing polypeptide is attached at its C-terminus by a peptide bond or via a peptide linker to the second N-terminus of the first domain if present, d) if the first domain is joined to the second domain via a first dimerizing polypeptide attached to the first C-terminus of the first domain, then the third domain is attached at its N-terminus by a peptide bond or via a peptide linker to
   i) the C-terminus of the first dimerizing polypeptide,
   ii) the second C-terminus of the first domain if present, or
   iii) the C-terminus of a third dimerizing polypeptide, wherein the third dimerizing polypeptide is attached at its N-terminus by a peptide bond or via a peptide linker to the second C-terminus of the first domain if present, e) if the second domain is joined to the first domain via a second dimerizing polypeptide attached to the first N-terminus of the second domain, then the fourth domain is attached at its C-terminus by a peptide bond or via a peptide linker to
   i) the N-terminus of the second dimerizing polypeptide,
   ii) the second N-terminus of the second domain if present, or
   iii) the N-terminus of a fourth dimerizing polypeptide, wherein the third dimerizing polypeptide is attached at its C-terminus by a peptide bond or via a peptide linker to the second N-terminus of the second domain if present, and f) if the second domain is joined to the first domain via a second dimerizing polypeptide attached to the first C-terminus of the second domain, then the fourth domain is attached at its N-terminus by a peptide bond or via a peptide linker to
   i) the C-terminus of the second dimerizing polypeptide,
   ii) the second C-terminus of the second domain if present, or
   iii) the C-terminus of a fourth dimerizing polypeptide, wherein the fourth dimerizing polypeptide is attached at its N-terminus by a peptide bond or via a peptide linker to the second C-terminus of the second domain if present.

In embodiments of the invention, in particular in any one of the embodiments of the preceding paragraph, the tetrahedral antibody additionally comprises a fifth and/or sixth domain, wherein:

a) the first domain is joined to the second domain via a first dimerizing polypeptide attached to the first N-terminus of the first domain, and wherein
   i) the fifth domain is attached at its C-terminus by a peptide bond or via a peptide linker to:
      (1) the N-terminus of the first dimerizing polypeptide,
      (2) the second N-terminus of the first domain, or
      (3) the N-terminus of a third dimerizing polypeptide, wherein the third dimerizing polypeptide is attached at its C-terminus by a peptide bond or via a peptide linker to the second N-terminus of the first domain,
b) the first domain is joined to the second domain via a first dimerizing polypeptide attached to the first C-terminus of the first domain, and wherein
   i) the fifth domain is attached at its N-terminus by a peptide bond or via a peptide linker to:
      (1) the C-terminus of the first dimerizing polypeptide,
      (2) the second C-terminus of the first domain, or
      (3) the C-terminus of a third dimerizing polypeptide, wherein the third dimerizing polypeptide is attached at its N-terminus by a peptide bond or via a peptide linker to the second C-terminus of the first domain,
c) the second domain is joined to the first domain via a second dimerizing polypeptide attached to the first N-terminus of the second domain, and wherein
   i) the sixth domain is attached at its C-terminus by a peptide bond or via a peptide linker to:
      (1) the N-terminus of the second dimerizing polypeptide,
      (2) the second N-terminus of the second domain, or
      (3) the N-terminus of a fourth dimerizing polypeptide, wherein the fourth dimerizing polypeptide is attached at its C-terminus by a peptide bond or via a peptide linker to the second N-terminus of the second domain, or
d) the second domain is joined to the first domain via a second dimerizing polypeptide attached to the first C-terminus of the second domain, and wherein
   i) the sixth domain is attached at its N-terminus by a peptide bond or via a peptide linker to:
      (1) the C-terminus of the second dimerizing polypeptide,
      (2) the second C-terminus of the second domain, or
      (3) the C-terminus of a fourth dimerizing polypeptide, wherein the fourth dimerizing polypeptide is attached at its N-terminus by a peptide bond or via a peptide linker to the second C-terminus of the second domain.

In embodiments of the tetrahedral molecule of the invention, in particular in any one of the embodiments of the preceding two paragraphs, the tetrahedral molecule further comprises a seventh and/or eighth domain, wherein:

a) the first domain is joined to the second domain via a first dimerizing polypeptide attached to the first N-terminus of the first domain, and wherein
   i) the seventh domain is attached at its N-terminus by a peptide bond or via a peptide linker to:
      (1) the first C-terminus of the first domain, or
      (2) the second C-terminus of the first domain,
b) the first domain is joined to the second domain via a first dimerizing polypeptide attached to the first C-terminus of the first domain, and wherein
   i) the seventh domain is attached at its C-terminus by a peptide bond or via a peptide linker to:
      (1) the first N-terminus of the first domain, or
      (2) the second N-terminus of the first domain,
c) the second domain is joined to the first domain via a second dimerizing polypeptide attached to the first N-terminus of the second domain, and wherein
   i) the eighth domain is attached at its N-terminus by a peptide bond or via a peptide linker to:
      (1) the first C-terminus of the second domain, or
      (2) the second C-terminus of the second domain, or
d) the second domain is joined to the first domain via a second dimerizing polypeptide attached to the first C-terminus of the second domain, and wherein
   i) the eighth domain is attached at its C-terminus by a peptide bond or via a peptide linker to:
      (1) the first N-terminus of the second domain, or
      (2) the second N-terminus of the second domain.

In embodiments of the tetrahedral molecule of the invention, in particular in any one of the embodiments of the preceding three paragraphs, the tetrahedral molecule further comprises a ninth and/or tenth domain, wherein:

a) the third domain
   i) is attached at its C-terminus by a peptide bond or via a peptide linker to the N-terminus of the first dimerizing polypeptide, and wherein the ninth domain is attached at its C-terminus by a peptide bond or via a peptide linker to an N-terminus of the third domain, or
   ii) is attached at its N-terminus by a peptide bond or via a peptide linker to the C-terminus of the first dimerizing polypeptide, and wherein the ninth domain is attached at its N-terminus by a peptide bond or via a peptide linker to a C-terminus of the third domain, and/or
b) the fourth domain
   i) is attached at its C-terminus by a peptide bond or via a peptide linker to the N-terminus of the second dimerizing polypeptide, and wherein the tenth domain is attached at its C-terminus by a peptide bond or via a peptide linker to an N-terminus of the fourth domain, or
   ii) is attached at its N-terminus by a peptide bond or via a peptide linker to the C-terminus of the second dimerizing polypeptide, and wherein the tenth domain is attached at its N-terminus by a peptide bond or via a peptide linker to a C-terminus of the fourth domain.

In any one of the embodiments of the tetrahedral molecule of the invention, in particular in any one of the embodiments of the preceding four paragraphs:

a) the first domain is an Fc domain or Fab domain,
b) the first domain is an Fc domain or Fab domain and the second domain is not an Fc domain or Fab domain,
c) the first domain is an Fc domain and the second domain is a Fab domain,
d) the first and second domains are Fc domains,
e) the first and second domains are Fab domain,
f) the second, third and/or fourth domain are selected from the group consisting of (i) a secreted protein, and (ii) the extracellular domain of a transmembrane protein,
g) the third domain is selected from the group of (i) a secreted protein, and (ii) the extracellular domain of a transmembrane protein, and the fourth domain is a Fab,
h) the third domain is IL-15,
i) the third domain is IL-15 and the fourth domain is an IL-15Rα sushi domain,
j) the third domain is IL-15 and the fourth domain is a Fab,
k) the third and fourth domains are each the ACE2 peptidase domain (PD),
l) the first and second domains are Fc domains, and the third and fourth domains are selected from the group consisting of (i) a secreted protein, and (ii) the extracellular domain of a transmembrane protein,
m) the first and second domains are Fc domains, the third domain is selected from the group consisting of (i) a secreted protein, and (ii) the extracellular domain of a transmembrane protein, and the fourth domain is Fab,
n) the first and second domains are Fc domains and the third and fourth domains are Fab domains,
o) the first and second domains are Fc domains and the third and fourth domains are each the ACE2 peptidase domain (PD),
p) the first domain is an Fc domain and the second, third and fourth domains are Fab domains,
q) the first domain is an Fc domain, the second domain is a Fab domain, the third domain is IL-15, and the fourth domain is an IL-15Rα sushi domain,
r) the first domain is an Fc domain, the second domain is a Fab domain, the third domain is IL-15, and the fourth domain is a Fab,
s) the first and/or second domain is a transmembrane domain of a protein other than ACE2 and/or collectrin, the first and second dimerizing polypeptides are selected from a collectrin-like domain (CLD) and a collectrin domain (CD), and the first domain and the second domain are joined to each other by a non-covalent linkage
    (1) between a first dimerizing polypeptide attached by a peptide bond or via a peptide linker to the first N-terminus of the first domain, and a second dimerizing polypeptide attached by a peptide bond or via a peptide linker to the first N-terminus of the second domain, or
    (2) between a first dimerizing polypeptide attached by a peptide bond or via a peptide linker to the first C-terminus of the first domain, and a second dimerizing polypeptide attached by a peptide bond or via a peptide linker to the first C-terminus of the second domain;
t) the first and/or second domain is a transmembrane domain of ACE2 and/or collectrin, the third and/or fourth domain is other than the ACE2 peptidase domain, and the first domain and the second domain are joined to each other by a non-covalent linkage
    (1) between a first dimerizing polypeptide attached by a peptide bond or via a peptide linker to the first N-terminus of the first domain, and a second dimerizing polypeptide attached by a peptide bond or via a peptide linker to the first N-terminus of the second domain, or
    (2) between a first dimerizing polypeptide attached by a peptide bond or via a peptide linker to the first C-terminus of the first domain, and a second dimerizing polypeptide attached by a peptide bond or via a peptide linker to the first C-terminus of the second domain;
u) the first and/or second domain is an ACE2 transmembrane domain and/or collectrin, the first and second dimerizing polypeptides are selected from a collectrin-like domain (CLD) and a collectrin domain (CD), the third and/or fourth domain is other than the ACE2 peptidase domain, and the first domain and the second domain are joined to each other by a non-covalent linkage
    (1) between a first dimerizing polypeptide attached by a peptide bond or via a peptide linker to the first N-terminus of the first domain, and a second dimerizing polypeptide attached by a peptide bond or via a peptide linker to the first N-terminus of the second domain, or
    (2) between a first dimerizing polypeptide attached by a peptide bond or via a peptide linker to the first C-terminus of the first domain, and a second dimerizing polypeptide attached by a peptide bond or via a peptide linker to the first C-terminus of the second domain;
v) the first and second dimerizing polypeptides are selected from a collectrin-like domain (CLD) and a collectrin domain (CD), preferably a CLD, and the first domain is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;
w) the first and second dimerizing polypeptides are selected from a collectrin-like domain (CLD) and a collectrin domain (CD), preferably a CLD, and the second domain is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;
x) the first and second dimerizing polypeptides are selected from a collectrin-like domain (CLD) and a collectrin domain (CD), preferably a CLD, and the third domain is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

y) the first and second dimerizing polypeptides are selected from a collectrin-like domain (CLD) and a collectrin domain (CD), preferably a CLD, and the fourth domain is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

z) the first and second dimerizing polypeptides are selected from a collectrin-like domain (CLD) and a collectrin domain (CD), preferably a CLD, and the fifth domain, if present, is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

aa) the first and second dimerizing polypeptides are selected from a collectrin-like domain (CLD) and a collectrin domain (CD), preferably a CLD, and the sixth domain, if present, is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

bb) the first and second dimerizing polypeptides are selected from a collectrin-like domain (CLD) and a collectrin domain (CD), preferably a CLD, and the seventh domain, if present, is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

cc) the first and second dimerizing polypeptides are selected from a collectrin-like domain (CLD) and a collectrin domain (CD), preferably a CLD, and the eighth domain, if present, is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

dd) the first and second dimerizing polypeptides are selected from a collectrin-like domain (CLD) and a collectrin domain (CD), preferably a CLD, and the first domain is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

ee) the first and second dimerizing polypeptides are selected from a collectrin-like domain (CLD) and a collectrin domain (CD), preferably a CLD, and the second domain is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

ff) the first and second dimerizing polypeptides are selected from a collectrin-like domain (CLD) and a collectrin domain (CD), preferably a CLD, and the third domain is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

gg) the first and second dimerizing polypeptides are selected from a collectrin-like domain (CLD) and a collectrin domain (CD), preferably a CLD, and the fourth domain is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

hh) the first and second dimerizing polypeptides are selected from a collectrin-like domain (CLD) and a collectrin domain (CD), preferably a CLD, and the fifth domain, if present, is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

ii) the first and second dimerizing polypeptides are selected from a collectrin-like domain (CLD) and a collectrin domain (CD), preferably a CLD, and the sixth domain, if present, is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

jj) the first and second dimerizing polypeptides are selected from a collectrin-like domain (CLD) and a collectrin domain (CD), preferably a CLD, and the seventh domain, if present, is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

kk) the first and second dimerizing polypeptides are selected from a collectrin-like domain (CLD) and a collectrin domain (CD), preferably a CLD, and the eighth domain, if present, is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

ll) the first, second, third, and/or fourth domains are a CD3 zeta chain intracellular binding domain, a CD28 intracellular binding domain, or a 4-1BB intracellular binding domain, a CD3 epsilon chain intracellular binding domain an ICOS intracellular binding domain, an OX40 intracellular binding domain, or a 4-1BB intracellular binding domain;

mm) the seventh and/or eighth domains, if present, are a CD3 zeta chain intracellular binding domain, a CD28 intracellular binding domain, or a 4-1BB intracellular binding domain, a CD3 epsilon chain intracellular binding domain an ICOS intracellular binding domain, an OX40 intracellular binding domain, or a 4-1BB intracellular binding domain;

nn) the first, second, third, and fourth domains are other than an ACE2 peptidase domain;

oo) the first, second, third, and fourth domains are other than an ACE2 peptidase domain and the first and second dimerizing polypeptides are each a collectrin-like domain (CLD);

pp) the first, second, third, and fourth domains are other than an ACE2 peptidase domain or ACE2 transmembrane domain;

qq) the first, second, third, and fourth domains are other than an ACE2 peptidase domain or ACE2 transmembrane domain and the first and second dimerizing polypeptides are each a collectrin-like domain (CLD);

rr) the tetrahedral molecule comprises a first, second, third, fourth, seventh and eighth domain, the first domain and the second domain are joined to each other by a non-covalent linkage between a first dimerizing polypeptide attached by a peptide bond or via a peptide linker to the first N-terminus of the first domain, and a second dimerizing polypeptide attached by a peptide bond or via a peptide linker to the first N-terminus of the second domain, and i) the third and fourth domains are each a binding domain of a protein or a portion or modified version thereof, preferably a binding domain of a secreted protein, an extracellular domain of a transmembrane protein, or an antibody or portion thereof, more preferably a single-chain moiety of an antibody, more preferably a single-chain or single domain antibody molecules, more preferably an scFv domain;

ii) the first and second domains are each a transmembrane domain, preferably a transmembrane domain of TNFRSF1, TNFRSF1B, LTBR, CD40, FasR, DCR3, CD27, CD30, DR4, DR5, DCR2, RANK, TWEAK-R, TACI, BAF-R, HVEM, BCMA, GITR, TROY, DR3, or XEDAR, more preferably a transmembrane domain of ACE2, Collectrin, CD8a, CD8b, CD3 zeta, CD3 epsilon, CD28, ICOS, OX40 or 4-1BB; and iii) the seventh and eighth domains are each an intracellular binding domain, preferably an intracellular binding domain of CD3 zeta chain, CD3 epsilon chain, CD28, ICOS, OX40, or 4-1BB;

ss) the tetrahedral molecule comprises a first, second, third, fourth, seventh and eighth domain, the first domain and the second domain are joined to each other by a non-covalent linkage between a first dimerizing polypeptide attached by a peptide bond or via a peptide linker to the first N-terminus of the first domain, and a second dimerizing polypeptide attached by a peptide bond or via a peptide linker to the first N-terminus of the second domain, the third and fourth domains are each an scFv domain, the first and second domains are each a transmembrane domain of ACE2, Collectrin, CD8a, CD8b, CD3 zeta, CD3 epsilon, CD28, ICOS, OX40 or 4-1BB, and the seventh and eighth domains are each an intracellular binding domain of CD3 zeta chain, CD3 epsilon chain, CD28, ICOS, OX40, or 4-1BB;

tt) the tetrahedral molecule comprises a first, second, third, fourth, ninth and tenth domain, the first domain and the second domain are joined to each other by a non-covalent linkage between a first dimerizing polypeptide attached by a peptide bond or via a peptide linker to the first N-terminus of the first domain, and a second dimerizing polypeptide attached by a peptide bond or via a peptide linker to the first N-terminus of the second domain, and i) the ninth and tenth domains are each a binding domain of a protein or a portion or modified version thereof, preferably a binding domain of a secreted protein, an extracellular domain of a transmembrane protein, or an antibody or portion thereof, more preferably a single-chain moiety of an antibody, more preferably a single-chain or single domain antibody molecules, more preferably an scFv domain;

ii) the third and fourth domains each a transmembrane domain, preferably a transmembrane domain of TNFRSF1, TNFRSF1B, LTBR, CD40, FasR, DCR3, CD27, CD30, DR4, DR5, DCR2, RANK, TWEAK-R, TACI, BAF-R, HVEM, BCMA, GITR, TROY, DR3, or XEDAR, more preferably a transmembrane domain of ACE2, Collectrin, CD8a, CD8b, CD3 zeta, CD3 epsilon, CD28, ICOS, OX40 or 4-1BB; and iii) the first and second domains are each an intracellular binding domain, preferably an intracellular binding domain of CD3 zeta chain, CD3 epsilon chain, CD28, ICOS, OX40, or 4-1BB;

uu) the tetrahedral molecule comprises a first, second, third, fourth, ninth and tenth domain, the first domain and the second domain are joined to each other by a non-covalent linkage between a first dimerizing polypeptide attached by a peptide bond or via a peptide linker to the first N-terminus of the first domain, and a second dimerizing polypeptide attached by a peptide bond or via a peptide linker to the first N-terminus of the second domain, the ninth and tenth domains are each an scFv domain, the third and fourth domains each a transmembrane domain of ACE2, Collectrin, CD8a, CD8b, CD3 zeta, CD3 epsilon, CD28, ICOS, OX40 or 4-1BB, and the first and second domains are each an intracellular binding domain of CD3 zeta chain, CD3 epsilon chain, CD28, ICOS, OX40, or 4-1BB;

vv) the tetrahedral molecule comprises a first, second, third, fourth, seventh and eighth domain, the first domain and the second domain are joined to each other by a non-covalent linkage between a first dimerizing polypeptide attached by a peptide bond or via a peptide linker to the first N-terminus of the first domain, and a second dimerizing polypeptide attached by a peptide bond or via a peptide linker to the first N-terminus of the second domain, and i) the third and fourth domains are each a binding domain of a protein or a portion or modified version thereof, preferably a binding domain of a secreted protein, an extracellular domain of a transmembrane protein, or an antibody or portion thereof, more preferably a single-chain moiety of an antibody, more preferably a single-chain or single domain antibody molecules, more preferably an scFv domain;

ii) the first and second domains are each a transmembrane domain, preferably a transmembrane domain of TNFRSF1, TNFRSF1B, LTBR, CD40, FasR, DCR3, CD27, CD30, DR4, DR5, DCR2, RANK, TWEAK-R, TACI, BAF-R, HVEM, BCMA, GITR, TROY, DR3, or XEDAR, more preferably a transmembrane domain of ACE2, Collectrin, CD8a, CD8b, CD3 zeta, CD3 epsilon, CD28, ICOS, OX40 or 4-1BB; and iii) the seventh and eighth domains are each an antigen or neo-antigen;

ww) the tetrahedral molecule comprises a first, second, third, fourth, seventh and eighth domain, the first domain and the second domain are joined to each other by a non-covalent linkage between a first dimerizing polypeptide attached by a peptide bond or via a peptide linker to the first N-terminus of the first domain, and a second dimerizing polypeptide attached by a peptide bond or via a peptide linker to the first N-terminus of the second domain, the third and fourth domains are each an scFv domain, the first and second domains are each a transmembrane domain of ACE2, Collectrin, CD8a, CD8b, CD3 zeta, CD3 epsilon, CD28, ICOS, OX40 or 4-1BB, and the seventh and eighth domains are each an antigen or neo-antigen;

xx) the tetrahedral molecule comprises a first, second, third, fourth, ninth and tenth domain, the first domain and the second domain are joined to each other by a non-covalent linkage between a first dimerizing polypeptide attached by a peptide bond or via a peptide linker to the first N-terminus of the first domain, and a second dimerizing polypeptide attached by a peptide bond or via a peptide linker to the first N-terminus of the second domain, and i) the ninth and tenth domains are each a binding domain of a protein or a portion or modified version thereof, preferably a binding domain of a secreted protein, an extracellular domain of a transmembrane protein, or an antibody or portion thereof, more preferably a single-chain moiety of an antibody, more preferably a single-chain or single domain antibody molecules, more preferably an scFv domain;

ii) the third and fourth domains each a transmembrane domain, preferably a transmembrane domain of TNFRSF1, TNFRSF1B, LTBR, CD40, FasR, DCR3, CD27, CD30, DR4, DR5, DCR2, RANK, TWEAK-R, TACI, BAF-R, HVEM, BCMA, GITR, TROY, DR3, or XEDAR, more preferably a transmembrane domain of ACE2, Collectrin, CD8a, CD8b, CD3 zeta, CD3 epsilon, CD28, ICOS, OX40 or 4-1BB; and iii) the first and second domains are each an antigen or neo-antigen;

yy) the tetrahedral molecule comprises a first, second, third, fourth, ninth and tenth domain, the first domain and the second domain are joined to each other by a non-covalent linkage between a first dimerizing polypeptide attached by a peptide bond or via a peptide linker to the first N-terminus of the first domain, and a second dimerizing polypeptide attached by a peptide bond or via a peptide linker to the first N-terminus of the second domain, the ninth and tenth domains are each an scFv domain, the third and fourth domains each a transmembrane domain of ACE2, Collectrin, CD8a, CD8b, CD3 zeta, CD3 epsilon, CD28, ICOS, OX40 or 4-1BB, and the first and second domains are each an antigen or neo-antigen.

In embodiments of the invention that comprise transmembrane domains as the first and second domains, preferably the tetrahedral molecule comprises first and second dimerizing polypeptides that are naturally associated with said transmembrane domains. For example, if the first and second domains are transmembrane domains of ACE2, the first and second dimerizing polypeptides are collectrin-like domain (CLD). Thus, in a preferred embodiment of any one of the above embodiments, the first and second domains are transmembrane domains of ACE2 and the first and second dimerizing polypeptides are collectrin-like domain (CLD).

In embodiments of the invention, in particular in any one of the embodiments of the preceding six paragraphs, the non-peptidyl linkage is a non-covalent linkage between a first dimerizing polypeptide attached to the first domain and a second dimerizing polypeptide attached to the second domain.

In embodiments of the invention, in particular in any one of the embodiments of the preceding seven paragraphs, the first and second dimerizing polypeptides are selected from the group consisting of:

a) dimerizing domains of an extracellular protein dimer, and b) dimerizing domains of an intracellular protein dimer.

In embodiments of the invention, in particular in any one of the embodiments of the preceding eight paragraphs, the first and second dimerizing polypeptides are selected from the group consisting of:

a) a leucine zipper domain, b) a collectrin-like domain (CLD), c) a collectrin domain (CD), d) a CD8 alpha extracellular domain, and e) a CD8 beta extracellular domain.

In preferred embodiments of the tetrahedral molecule of the invention, in particular in any one of the embodiments of the preceding nine paragraphs, the first and second dimerizing polypeptides are selected from a collectrin-like domain (CLD) and a collectrin domain (CD), preferably a collectrin-like domain (CLD).

In embodiments of the invention:

a) the first dimerizing polypeptide is the same as the second dimerizing polypeptide, and b) the dimerizing polypeptides form a homodimer.

In embodiments of the invention:

a) the first dimerizing polypeptide is different than the second dimerizing polypeptide, and b) the first and second dimerizing polypeptides form a heterodimer.

In embodiments of the invention wherein the first and second dimerizing polypeptides form a heterodimer:

a) the first and second dimerizing polypeptides are selected from the group consisting of:

i) a T cell receptor alpha and T cell receptor beta extracellular domain, ii) a T cell receptor gamma and T cell receptor extracellular domain, iii) an MHC class I alpha extracellular domain and beta-2 microglobulin iv) an MHC class II alpha and MHC class II beta extracellular domain, and v) a CD8 alpha and CD8 beta extracellular domain, b) the first dimerizing polypeptide is different from the second dimerizing polypeptide, and c) the first and second dimerizing polypeptides form a heterodimer.

In some of these embodiments of the invention, the first and second dimerizing polypeptides, when in the presence of each other, form less than 30%, 20%, 10%, 5%, 4%, 3%, 2%, or 1% homodimers.

Dimeric Fusion Proteins

This invention also provides a non-naturally occurring fusion protein dimer comprising a dimer of a first dimerizing polypeptide and a second dimerizing polypeptide, wherein:

a) the first dimerizing polypeptide is attached by a peptide bond or via a peptide linker at its N-terminus or C-terminus to a first domain, b) the second dimerizing polypeptide is optionally attached by a peptide bond or via a peptide linker at its N-terminus or C-terminus to a second domain, c) the first and second dimerizing polypeptides are selected from the group consisting of:

i) a collectrin-like domain (CLD), and ii) a collectrin domain (CD), d) the first dimerizing polypeptide is optionally attached by a peptide bond or via a peptide linker at its remaining free N-terminus or C-terminus to a third domain, and e) the second dimerizing polypeptide is optionally attached by a peptide bond or via a peptide linker at its remaining free N-terminus or C-terminus to a fourth domain.

In any one of the above embodiments, the first and second dimerizing polypeptides are collectrin-like domain (CLD).

In embodiments of the invention, the tetrahedral molecule or non-naturally occurring fusion protein dimer:

a) does not comprise i) an ACE2 PD at the N-terminal side of either dimerizing polypeptide; and/or ii) an ACE2 transmembrane domain and/or collectrin transmembrane domain at the C-terminal side of either dimerizing polypeptide; or b) comprises i) an ACE2 PD at the N-terminal side of either dimerizing polypeptide; and/or ii) an ACE2 transmembrane domain and/or collectrin transmembrane domain at the C-terminal side of either dimerizing polypeptide.

In embodiments of the invention wherein the first and second dimerizing polypeptides form a heterodimer and the dimerizing polypeptides are collectrin-like domain (CLD), the CLD comprises substitutions that disrupt homodimer formation in the CLD dimerizing polypeptide, preferably wherein the substitutions are at Arg652, Arg710, Tyr641, Tyr633, Asn638, Glu639, Gln653, Asn636, Ser709, Asp713, and/or Arg716, more preferably wherein Tyr641 and Tyr633 are substituted with positively charged amino acids lysine, arginine or histidine and Arg652 and Arg710 are substituted with the negatively charged amino acids glutamic acid or aspartic acid or the positively amino acid lysine.

In embodiments of the invention wherein the first and second dimerizing polypeptides form a heterodimer and the dimerizing polypeptides are collectrin, the collectrin dimerizing polypeptide comprises substitutions that disrupt homodimer formation in the collectrin dimerizing polypeptide, preferably wherein the substitutions are at Arg59, Arg111, Tyr48, and/or Tyr40, more preferably wherein Tyr48 and/or Tyr40 are substituted with positively charged amino acids lysine, arginine or histidine and Arg59 and/or Arg111 are substituted with the negatively charged amino acids glutamic acid or aspartic acid or the positively charge amino acid lysine.

In embodiments wherein the dimerizing polypeptides are collectrin-like domain (CLD), and, the CLD comprises substitutions that promote heterodimer formation in the CLD dimerizing polypeptide, and preferably:

a) Tyr633 on either of the first or second CLD dimerizing polypeptide is substituted, preferably with either a positively charge or negatively charged amino acid;

b) Tyr641 on either of the first or second CLD dimerizing polypeptide is substituted, preferably with either a positively charge or negatively charged amino acid;

c) Arg652 on either of the first or second CLD dimerizing polypeptide is substituted, preferably with either a positively charge or negatively charged amino acid;

d) Arg710 on either of the first or second CLD dimerizing polypeptide is substituted, preferably with either a positively charge or negatively charged amino acid;

e) Ser709 on either of the first or second CLD dimerizing polypeptide is substituted, preferably with either a positively charge or negatively charged amino acid; and/or f) Asp713 on either of the first or second CLD dimerizing polypeptide is substituted, preferably with either a positively charge or negatively charged amino acid.

In embodiments wherein the dimerizing polypeptides are collectrin and the collectrin dimerizing polypeptide comprises substitutions that promote heterodimer formation in the collectrin dimerizing polypeptide, preferably a) Tyr40 on either the first or second collectrin dimerizing polypeptide is substituted, preferably with either a positively charge or negatively charged amino acid;

b) Tyr48 on either the first or second collectrin dimerizing polypeptide is substituted, preferably with either a positively charge or negatively charged amino acid;

c) Arg59 on either the first or second collectrin dimerizing polypeptide is substituted, preferably with either a positively charge or negatively charged amino acid; and/or d) Arg111 on either the first or second collectrin dimerizing polypeptide is substituted, preferably with either a positively charge or negatively charged amino acid.

In embodiments wherein the dimerizing polypeptides are collectrin-like domain (CLD), and, the CLD comprises substitutions that promote heterodimer formation in the CLD dimerizing polypeptide, and preferably:

a) Tyr633 on the first CLD dimerizing polypeptide is substituted with either a positively charge or negatively charged amino acid, and Arg710 on the second CLD dimerizing polypeptide is substituted with the other of a positively charge or negatively charged amino acid;

b) Tyr633 on the second CLD dimerizing polypeptide is substituted with either a positively charge or negatively charged amino acid, and Arg710 on the first CLD dimerizing polypeptide is substituted with the other of a positively charge or negatively charged amino acid;

c) Tyr641 on the first CLD dimerizing polypeptide is substituted with either a positively charge or negatively charged amino acid, and Arg652 on the second CLD dimerizing polypeptide is substituted with the other of a positively charge or negatively charged amino acid;

d) Tyr641 on the second CLD dimerizing polypeptide is substituted with either a positively charge or negatively charged amino acid, and Arg652 on the first CLD dimerizing polypeptide is substituted with the other of a positively charge or negatively charged amino acid;

e) Arg652 on the first CLD dimerizing polypeptide is substituted with either a positively charge or negatively charged amino acid, and Asn638 on the second CLD dimerizing polypeptide is substituted with the other of a positively charge or negatively charged amino acid;

f) Arg652 on the second CLD dimerizing polypeptide is substituted with either a positively charge or negatively charged amino acid, and Arg638 on the first CLD dimerizing polypeptide is substituted with the other of a positively charge or negatively charged amino acid;

g) Arg710 on the first CLD dimerizing polypeptide is substituted with either a positively charge or negatively charged amino acid, and Glu639 on the second CLD dimerizing polypeptide is substituted with the other of a positively charge or negatively charged amino acid;

h) Arg710 on the second CLD dimerizing polypeptide is substituted with either a positively charge or negatively charged amino acid, and Glu639 on the first CLD dimerizing polypeptide is substituted with the other of a positively charge or negatively charged amino acid;

i) Ser709 on the first CLD dimerizing polypeptide is substituted with either a positively charge or negatively charged amino acid, and Arg716 on the second CLD dimerizing polypeptide is substituted with the other of a positively charge or negatively charged amino acid;

j) Ser709 on the second CLD dimerizing polypeptide is substituted with either a positively charge or negatively charged amino acid, and Arg716 on the first CLD dimerizing polypeptide is substituted with the other of a positively charge or negatively charged amino acid;

k) Asp713 on the first CLD dimerizing polypeptide is substituted with either a positively charge or negatively charged amino acid, and Arg716 on the second CLD dimerizing polypeptide is substituted with the other of a positively charge or negatively charged amino acid; and/or l) Asp713 on the second CLD dimerizing polypeptide is substituted with either a positively charge or negatively charged amino acid, and Arg716 on the first CLD dimerizing polypeptide is substituted with the other of a positively charge or negatively charged amino acid.

In embodiments wherein the dimerizing polypeptides are collectrin and the collectrin dimerizing polypeptide comprises substitutions that promote heterodimer formation in the collectrin dimerizing polypeptide, preferably a) Tyr40 on the first collectrin dimerizing polypeptide is substituted with either a positively charge or negatively charged amino acid, and Arg111 on the second collectrin dimerizing polypeptide is substituted with the other of a positively charge or negatively charged amino acid;

b) Tyr40 on the second collectrin dimerizing polypeptide is substituted with either a positively charge or negatively charged amino acid, and Arg111 on the first collectrin dimerizing polypeptide is substituted with the other of a positively charge or negatively charged amino acid;

c) Tyr48 on the first collectrin dimerizing polypeptide is substituted with either a positively charge or negatively charged amino acid, and Arg59 on the second collectrin dimerizing polypeptide is substituted with the other of a positively charge or negatively charged amino acid; and/or d) Tyr48 on the second collectrin dimerizing polypeptide is substituted with either a positively charge or negatively charged amino acid, and Arg59 on the first collectrin dimerizing polypeptide is substituted with the other of a positively charge or negatively charged amino acid.

Octahedral Antibodies

This invention also provides an octahedral antibody comprising a first, second, third, fourth, fifth and sixth domain, wherein:

a) each of the first, second and third domains are selected from the group consisting of a Fab domain and an Fc domain, b) each of the first, second and third domains comprise:
   i) a first polypeptide chain comprising a first N-terminus of the domain, and
   ii) a second polypeptide chain comprising a second N-terminus of the domain, c) the first N-terminus of the first domain, the first N-terminus of the second domain and the first N-terminus of the third domain are joined to each other by a non-peptidyl linkage wherein the non-peptidyl linkage is:
   i) a branched covalent linkage, or
   ii) a non-covalent linkage between
      (1) a first trimerizing polypeptide attached by a peptide bond or via a peptide linker to the first N-terminus of the first domain,
      (2) a second trimerizing polypeptide attached by a peptide bond or via a peptide linker to the first N-terminus of the second domain, and
      (3) a third trimerizing polypeptide attached by a peptide bond or via a peptide linker to the first N-terminus of the third domain,
   wherein the first, second, and third trimerizing polypeptides are not immunoglobulin polypeptides, d) the fourth domain is attached at its C-terminus by a peptide bond or via a peptide linker to:
   i) the second N-terminus of the first domain, or
   ii) the N-terminus terminus of the first trimerizing polypeptide, e) the fifth domain is attached at its C-terminus by a peptide bond or via a peptide linker to:
   i) the second N-terminus of the second domain, or
   ii) the N-terminus of the second trimerizing polypeptide, and f) the sixth domain is attached at its C-terminus by a peptide bond or via a peptide linker to:
   i) the second N-terminus of the third domain, or
   ii) the N-terminus of the third trimerizing polypeptide.

In embodiments of the octahedral antibody of the invention, the non-peptidyl linkage is a non-covalent linkage between a first trimerizing polypeptide attached to the first N-terminus of the first domain, a second trimerizing polypeptide attached to the first N-terminus of the second domain, and a third trimerizing polypeptide attached to the first N-terminus of the third domain, wherein the first, second, and third trimerizing polypeptides are selected from the group consisting of TNF ligand superfamily members OX40L/TNFLSF4, CD40L/TNFLSF5, FASL/TNFLSF6, CD70L/TNFLSF7, CD30L/TNFLSF8, 4-1BBL/TNFLSF9, TRAIL/TNFLSF10, RANKL/TNFLSF11, TWEAK/TNFLSF12, APRIL/TNFLSF13, BAFF/TNFLSF13B, LIGHT/TNFLSF14, VEGI/TNFLSF15, GITRL/TNFLSF18, EctodyplasinATNFLSF19, TNF/TNFLSF2, lymphotoxin alpha/TNFLSF1, and lymphotoxin beta/TNFLSF3. In a preferred embodiment, the trimerizing polypeptides are selected from the group consisting of SEQ ID NOs: 787-790 (TNFSF1), SEQ ID NOs: 791-792 (TNFSF2), SEQ ID NOs: 793-795 (TNFSF3), SEQ ID NOs: 796-798 (TNFSF4), SEQ ID NOs: 799-802 (TNFSF5), SEQ ID NOs: 803-806, SEQ ID NOs: 807-809 (TNFSF7), SEQ ID NOs: 810-813 (TNFSF8), SEQ ID NOs: 814-816 (TNFSF9), SEQ ID NOs: 817-820 (TNFSF10), SEQ ID NOs: 821-822 (TNFSF11), SEQ ID NOs: 823-827 (TNFSF12), SEQ ID NOs: 828-831 (TNFSF13), SEQ ID NOs: 832-833 (TNFSF13B), SEQ ID NOs: 834-837 (TNFSF14), SEQ ID NOs: 838-841 (TNFSF15), and SEQ ID NOs: 842-843 (TNFSF18).

In embodiments of the invention, the octahedral antibody further comprises a seventh, eighth, and/or ninth domain, wherein:

- a) the seventh domain is attached at its C-terminus by a peptide bond or via a peptide linker to the second N-terminus of the first domain,
- b) the eighth domain is attached at its C-terminus by a peptide bond or via a peptide linker to the second N-terminus of the second domain, and/or
- c) the ninth domain is attached at its C-terminus by a peptide bond or via a peptide linker to the second N-terminus of the third domain.

In embodiments of the invention, the octahedral antibody further comprises a tenth, eleventh, and/or twelfth domain, wherein:

- a) the tenth domain is attached at its N-terminus by a peptide bond or via a peptide linker to:
  - i) the first C-terminus of the first domain, or
  - ii) the second C-terminus of the first domain,
- b) the eleventh domain is attached at its N-terminus by a peptide bond or via a peptide linker to:
  - i) the first C-terminus of the second domain, or
  - ii) the second C-terminus of the second domain,
- c) the twelfth domain is attached at its N-terminus by a peptide bond or via a peptide linker to:
  - i) the first C-terminus of the third domain, or
  - ii) the second C-terminus of the third domain.

In embodiments, the first, second, and third domains of octahedral antibodies of the invention may be any of the domains described herein as the first and second domains of a tetrahedral antibody of the invention. In embodiments, the fourth, fifth and sixth domains of octahedral antibodies of the invention may be any of the domains described herein as the third and fourth domains of a tetrahedral antibody of the invention. In embodiments, the seventh, eighth, and ninth domains of octahedral antibodies of the invention may be any of the domains described herein as the fifth and sixth domains of a tetrahedral antibody of the invention. In embodiments, the tenth, eleventh and twelfth domains of octahedral antibodies of the invention may be any of the domains described herein as the seventh and eighth domains of a tetrahedral antibody of the invention. Further, all such domains may comprise any of the features (such as mutations) described with respect to domains of tetrahedral antibodies of the invention.

Octahedral Molecules

This invention also provides an octahedral molecule comprising a first, second, third, fourth, fifth and sixth domain, wherein:

- a) at least one of the first, second and third domains are not Fab or Fc domains, and each of the first, second, third, fourth, fifth, and sixth domains independently comprise:
  - i) a first polypeptide chain comprising a first N-terminus and a first C-terminus of the domain, and
  - ii) optionally a second polypeptide chain comprising a second N-terminus and a second C-terminus of the domain,
- b) the first N-terminus of the first domain, the first N-terminus of the second domain and the first N-terminus of the third domain are joined to each other by a non-covalent linkage between
  - (1) a first trimerizing polypeptide attached by a peptide bond or via a peptide linker to the first N-terminus of the first domain,
  - (2) a second trimerizing polypeptide attached by a peptide bond or via a peptide linker to the first N-terminus of the second domain, and
  - (3) a third trimerizing polypeptide attached by a peptide bond or via a peptide linker to the first N-terminus of the third domain, wherein the first, second, and third trimerizing polypeptides are not immunoglobulin polypeptides,
- c) the fourth domain is attached at its first C-terminus by a peptide bond or via a peptide linker to:
  - i) the N-terminus terminus of the first trimerizing polypeptide, or
  - ii) the second N-terminus of the first domain, if present,
- d) the fifth domain is attached at its first C-terminus by a peptide bond or via a peptide linker to:
  - i) the N-terminus of the second trimerizing polypeptide, or
  - ii) the second N-terminus of the second domain, if present, and
- e) the sixth domain is attached at its first C-terminus by a peptide bond or via a peptide linker to:
  - i) the N-terminus of the third trimerizing polypeptide, or
  - ii) the second N-terminus of the third domain, if present.

In embodiments of the octahedral molecule of the invention, in particular in any one of the embodiments of the preceding paragraph, the first, second, and third trimerizing polypeptides are selected from the group consisting of TNF ligand superfamily members OX40L/TNFLSF4, CD40L/TNFLSF5, FASL/TNFLSF6, CD70L/TNFLSF7, CD30L/TNFLSF8, 4-1BBL/TNFLSF9, TRAIL/TNFLSF10, RANKL/TNFLSF11, TWEAK/TNFLSF12, APRIL/TNFLSF13, BAFF/TNFLSF13B, LIGHT/TNFLSF14, VEGI/TNFLSF15, GITRL/TNFLSF18, EctodyplasinATNFLSF19, TNF/TNFLSF2, lymphotoxin alpha/TNFLSF1, and lymphotoxin beta/TNFLSF3. In a preferred embodiment, the trimerizing polypeptides are selected from the group consisting of SEQ ID NOs: 787-790 (TNFSF1), SEQ ID NOs: 791-792 (TNFSF2), SEQ ID NOs: 793-795 (TNFSF3), SEQ ID NOs: 796-798 (TNFSF4), SEQ ID NOs: 799-802 (TNFSF5), SEQ ID NOs: 803-806, SEQ ID NOs: 807-809 (TNFSF7), SEQ ID NOs: 810-813 (TNFSF8), SEQ ID NOs: 814-816 (TNFSF9), SEQ ID NOs: 817-820 (TNFSF10), SEQ ID NOs: 821-822 (TNFSF11), SEQ ID NOs: 823-827 (TNFSF12), SEQ ID NOs: 828-831 (TNFSF13), SEQ ID NOs: 832-833 (TNFSF13B), SEQ ID NOs: 834-837 (TNFSF14), SEQ ID NOs: 838-841 (TNFSF15), and SEQ ID NOs: 842-843 (TNFSF18)

In embodiments of the invention, in particular in any one of the embodiments of the preceding two paragraphs, the octahedral molecule further comprises a seventh, eighth, and/or ninth domain, wherein:

a) the seventh domain is attached at its C-terminus by a peptide bond or via a peptide linker to the second N-terminus of the first domain, if present, b) the eighth domain is attached at its C-terminus by a peptide bond or via a peptide linker to the second N-terminus of the second domain, if present, and/or c) the ninth domain is attached at its C-terminus by a peptide bond or via a peptide linker to the second N-terminus of the third domain, if present.

In embodiments of the invention, in particular in any one of the embodiments of the preceding three paragraphs, the octahedral molecule further comprises a tenth, eleventh, and/or twelfth domain, wherein:

a) the tenth domain is attached:
   i) at its N-terminus by a peptide bond or via a peptide linker to a C-terminus of the first domain, or
   ii) at its C-terminus by a peptide bond or via a peptide linker to an N-terminus of the fourth domain, b) the eleventh domain is attached:
   i) at its N-terminus by a peptide bond or via a peptide linker to a first C-terminus of the second domain, or
   ii) at its C-terminus by a peptide bond or via a peptide linker to the N-terminus of the fifth domain, c) the twelfth domain is attached:
   i) at its N-terminus by a peptide bond or via a peptide linker to a first C-terminus of the third domain, or
   ii) at its C-terminus by a peptide bond or via a peptide linker to the N-terminus of the sixth domain.

In embodiments, in particular in any one of the embodiments of the preceding four paragraphs, the first, second, and third domains of octahedral molecule of the invention may be any of the domains, preferably other than Fc or Fab domains, described herein as the first and second domains of a tetrahedral antibody or molecule of the invention. In embodiments, the fourth, fifth and sixth domains of octahedral molecules of the invention may be any of the domains described herein as the third and fourth domains of a tetrahedral antibody or molecule of the invention, preferably other than Fc or Fab domains. In embodiments, the seventh, eighth, and ninth domains of octahedral molecules of the invention may be any of the domains described herein as the fifth and sixth domains of a tetrahedral antibody or molecule of the invention. In embodiments, the tenth, eleventh and twelfth domains of octahedral molecules of the invention may be any of the domains described herein as the seventh and eighth domains of a tetrahedral antibody or molecule of the invention, or ninth and tenth domains of a tetrahedral molecule of the invention. Further, all such domains may comprise any of the features (such as mutations) described with respect to domains of tetrahedral antibodies of the invention.

In any one of the embodiments of the octahedral molecule of the invention, in particular in any one of the embodiments of the preceding five paragraphs, the first, second and third domains are each other than an Fc or Fab domain. In any one of the embodiments of the octahedral molecule of the invention, in particular in any one of the embodiments of the preceding five paragraphs, the first, second, third, fourth, fifth and sixth domains are each other than an Fc or Fab domain.

In any one of the embodiments of the octahedral molecule of the invention, in particular in any one of the embodiments of the preceding six paragraphs:

a) the first, second, and/or third domains are selected from the group consisting of (i) a secreted protein, and (ii) the extracellular domain of a transmembrane protein, b) the fourth, fifth, and/or sixth domains are selected from the group consisting of (i) a secreted protein, and (ii) the extracellular domain of a transmembrane protein, c) the first, second and third trimerizing polypeptides are selected from the group consisting of TNF ligand superfamily members OX40L/TNFLSF4, CD40L/TNFLSF5, FASL/TNFLSF6, CD70L/TNFLSF7, CD30L/TNFLSF8, 4-1BBL/TNFLSF9, TRAIL/TNFLSF10, RANKL/TNFLSF11, TWEAK/TNFLSF12, APRIL/TNFLSF13, BAFF/TNFLSF13B, LIGHT/TNFLSF14, VEGI/TNFLSF15, GITRL/TNFLSF18, EctodyplasinATNFLSF19, TNF/TNFLSF2, lymphotoxin alpha/TNFLSF1, and lymphotoxin beta/TNFLSF3;

d) the first, second and third trimerizing polypeptides are selected from the group consisting of SEQ ID NOs: 787-790 (TNFSF1), SEQ ID NOs: 791-792 (TNFSF2), SEQ ID NOs: 793-795 (TNFSF3), SEQ ID NOs: 796-798 (TNFSF4), SEQ ID NOs: 799-802 (TNFSF5), SEQ ID NOs: 803-806, SEQ ID NOs: 807-809 (TNFSF7), SEQ ID NOs: 810-813 (TNFSF8), SEQ ID NOs: 814-816 (TNFSF9), SEQ ID NOs: 817-820 (TNFSF10), SEQ ID NOs: 821-822 (TNFSF11), SEQ ID NOs: 823-827 (TNFSF12), SEQ ID NOs: 828-831 (TNFSF13), SEQ ID NOs: 832-833 (TNFSF13B), SEQ ID NOs: 834-837 (TNFSF14), SEQ ID NOs: 838-841 (TNFSF15), and SEQ ID NOs: 842-843 (TNFSF18);

e) the first, second and third trimerizing polypeptides are selected from the group consisting of TNF ligand superfamily members OX40L/TNFLSF4, CD40L/TNFLSF5, FASL/TNFLSF6, CD70L/TNFLSF7, CD30L/TNFLSF8, 4-1BBL/TNFLSF9, TRAIL/TNFLSF10, RANKL/TNFLSF11, TWEAK/TNFLSF12, APRIL/TNFLSF13, BAFF/TNFLSF13B, LIGHT/TNFLSF14, VEGI/TNFLSF15, GITRL/TNFLSF18, EctodyplasinATNFLSF19, TNF/TNFLSF2, lymphotoxin alpha/TNFLSF1, and lymphotoxin beta/TNFLSF3, and the first, second and/or third domain is a transmembrane domain that is not naturally associated with the selected first, second and third trimerizing polypeptides;

f) the first, second and third trimerizing polypeptides are selected from the group consisting of SEQ ID NOs: 787-790 (TNFSF1), SEQ ID NOs: 791-792 (TNFSF2), SEQ ID NOs: 793-795 (TNFSF3), SEQ ID NOs: 796-798 (TNFSF4), SEQ ID NOs: 799-802 (TNFSF5), SEQ ID NOs: 803-806, SEQ ID NOs: 807-809 (TNFSF7), SEQ ID NOs: 810-813 (TNFSF8), SEQ ID NOS: 814-816 (TNFSF9), SEQ ID NOs: 817-820 (TNFSF10), SEQ ID NOs: 821-822 (TNFSF11), SEQ ID NOs: 823-827 (TNFSF12), SEQ ID NOs: 828-831 (TNFSF13), SEQ ID NOs: 832-833 (TNFSF13B), SEQ ID NOs: 834-837 (TNFSF14), SEQ ID NOs: 838-841 (TNFSF15), and SEQ ID NOs: 842-843 (TNFSF18), and the first, second and/or third domain is a transmembrane domain that is not naturally associated with the selected first, second and third trimerizing polypeptides, g) the first domain is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

h) the second domain is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

i) the third domain is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

j) the fourth domain is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

k) the fifth domain is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

l) the sixth domain is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

m) the seventh domain, if present, is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

n) the eighth domain, if present, is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

o) the ninth domain, if present, is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

p) the tenth domain, if present, is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

q) the eleventh domain, if present, is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

r) the twelfth domain, if present, is selected from the group consisting of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

s) the first domain is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

t) the second domain is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

u) the third domain is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

v) the fourth domain is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

w) the fifth domain is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

x) the sixth domain is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

y) the seventh domain, if present, is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

z) the eighth domain, if present, is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

aa) the ninth domain, if present, is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

bb) the tenth domain, if present, is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

cc) the eleventh domain, if present, is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

dd) the twelfth domain, if present, is other than any one of: a binding domain of a protein or a portion or modified version thereof, a secreted protein or a portion or modified version thereof, a transmembrane protein or a portion or modified version thereof, an intracellular binding domain or a portion or modified version thereof, and an antibody or a portion or modified version thereof;

ee) the first, second, third, fourth, fifth, and/or sixth domains are a CD3 zeta chain intracellular binding domain, a CD28 intracellular binding domain, or a 4-1BB intracellular binding domain, a CD3 epsilon chain intracellular binding domain an ICOS intracellular binding domain, an OX40 intracellular binding domain, or a 4-1BB intracellular binding domain;

ff) the tenth, eleventh, and/or twelfth domains, if present, are a CD3 zeta chain intracellular binding domain, a CD28 intracellular binding domain, or a 4-1BB intracellular binding domain, a CD3 epsilon chain intracellular binding domain an ICOS intracellular binding domain, an OX40 intracellular binding domain, or a 4-1BB intracellular binding domain;

gg) the octahedral molecule comprises a first, second, third, fourth, fifth, sixth, tenth, eleventh and twelfth domain, and:

i) the fourth, fifth and sixth domains are each a binding domain of a protein or a portion or modified version thereof, preferably a binding domain of a secreted protein, an extracellular domain of a transmembrane protein, or an antibody or portion thereof, more preferably a single-chain moiety of an antibody, more preferably a single-chain or single domain antibody molecules, more preferably an scFv domain;

ii) the first, second, and third domains are each a transmembrane domain, preferably a transmembrane domain of TNFRSF1, TNFRSF1B, LTBR, CD40, FasR, DCR3, CD27, CD30, DR4, DR5, DCR2, RANK, TWEAK-R, TACI, BAF-R, HVEM, BCMA, GITR, TROY, DR3, or XEDAR, more preferably a transmembrane domain of ACE2, Collectrin, CD8a, CD8b, CD3 zeta, CD3 epsilon, CD28, ICOS, OX40, 4-1BB, TNFSF1, TNFSF2, TNFSF3, TNFSF4, TNFSF5, TNFSF6, TNFSF7, TNFSF8, TNFSF9, TNFSF10, TNFSF11, TNFSF12, TNFSF13, TNFSF13B, TNFSF14, TNFSF15 or TNFSF18; and iii) the tenth, eleventh and twelfth domains are each attached at an N-terminus to a C-terminus of the first, second and third domains, respectively, and each are an intracellular binding domain, preferably an intracellular binding domain of CD3 zeta chain, CD3 epsilon chain, CD28, ICOS, OX40, or 4-1BB;

hh) the octahedral molecule comprises a first, second, third, fourth, fifth, sixth, tenth, eleventh and twelfth domain, the fourth, fifth and sixth domains are each an scFv domain, the first, second, and third domains are each a transmembrane domain of ACE2, Collectrin, CD8a, CD8b, CD3 zeta, CD3 epsilon, CD28, ICOS, OX40 or 4-1BB, and the tenth, eleventh and twelfth domains are each attached at an N-terminus to a C-terminus of the first, second and third domains, respectively, and each are an intracellular binding domain of CD3 zeta chain, CD3 epsilon chain, CD28, ICOS, OX40, or 4-1BB;

ii) the octahedral molecule comprises a first, second, third, fourth, fifth, sixth, tenth, eleventh and twelfth domain, and:

i) the tenth, eleventh and twelfth domains are each attached at a C-terminus to an N-terminus of the fourth, fifth, and sixth domains, respectively, and each are a binding domain of a protein or a portion or modified version thereof, preferably a binding domain of a secreted protein, an extracellular domain of a transmembrane protein, or an antibody or portion thereof, more preferably a single-chain moiety of an antibody, more preferably a single-chain or single domain antibody molecules, more preferably an scFv domain;

ii) the fourth, fifth, and sixth are each a transmembrane domain, preferably a transmembrane domain of TNFSF1, TNFSF2, TNFSF3, TNFSF4, TNFSF5, TNFSF6, TNFSF7, TNFSF8, TNFSF9, TNFSF10, TNFSF11, TNFSF12, TNFSF13, TNFSF13B, TNFSF14, TNFSF15 or TNFSF18, more preferably a transmembrane domain of ACE2, Collectrin, CD8a, CD8b, CD3 zeta, CD3 epsilon, CD28, ICOS, OX40, 4-1BB, TNFRSF1, TNFRSF1B, LTBR, CD40, FasR, DCR3, CD27, CD30, DR4, DR5, DCR2, RANK, TWEAK-R, TACI, BAF-R, HVEM, BCMA, GITR, TROY, DR3, or XEDAR; and iii) the first, second, and third domains are each an intracellular binding domain, preferably an intracellular binding domain of CD3 zeta chain, CD3 epsilon chain, CD28, ICOS, OX40, or 4-1BB; or jj) the octahedral molecule comprises a first, second, third, fourth, fifth, sixth, tenth, eleventh and twelfth domain, and the tenth, eleventh and twelfth domains are each attached at a C-terminus to an N-terminus of the fourth, fifth, and sixth domains, respectively, and each are an scFv domain, the fourth, fifth, and sixth are each a transmembrane domain of ACE2, Collectrin, CD8a, CD8b, CD3 zeta, CD3 epsilon, CD28, ICOS, OX40 or 4-1BB, and the first, second, and third domains are each an intracellular binding domain of CD3 zeta chain, CD3 epsilon chain, CD28, ICOS, OX40, or 4-1BB;

kk) the octahedral molecule comprises a first, second, third, fourth, fifth, sixth, tenth, eleventh and twelfth domain, and:

i) the fourth, fifth and sixth domains are each a binding domain of a protein or a portion or modified version thereof, preferably a binding domain of a secreted protein, an extracellular domain of a transmembrane protein, or an antibody or portion thereof, more preferably a single-chain moiety of an antibody, more preferably a single-chain or single domain antibody molecules, more preferably an scFv domain;

ii) the first, second, and third domains are each a transmembrane domain, preferably a transmembrane domain of TNFRSF1, TNFRSF1B, LTBR, CD40, FasR, DCR3, CD27, CD30, DR4, DR5, DCR2, RANK, TWEAK-R, TACI, BAF-R, HVEM, BCMA, GITR, TROY, DR3, or XEDAR, more preferably a transmembrane domain of ACE2, Collectrin, CD8a, CD8b, CD3 zeta, CD3 epsilon, CD28, ICOS, OX40, 4-1BB, TNFSF1, TNFSF2, TNFSF3, TNFSF4, TNFSF5, TNFSF6, TNFSF7, TNFSF8, TNFSF9, TNFSF10, TNFSF11, TNFSF12, TNFSF13, TNFSF13B, TNFSF14, TNFSF15 or TNFSF18; and iii) the tenth, eleventh and twelfth domains are each attached at an N-terminus to a C-terminus of the first, second and third domains, respectively, and each are an antigen or neo-antigen;

ll) the octahedral molecule comprises a first, second, third, fourth, fifth, sixth, tenth, eleventh and twelfth domain, the fourth, fifth and sixth domains are each an scFv domain, the first, second, and third domains are each a transmembrane domain of ACE2, Collectrin, CD8a, CD8b, CD3 zeta, CD3 epsilon, CD28, ICOS, OX40 or 4-1BB, and the tenth, eleventh and twelfth domains are each attached at an N-terminus to a C-terminus of the first, second and third domains, respectively, and each are an antigen or neo-antigen;

mm) the octahedral molecule comprises a first, second, third, fourth, fifth, sixth, tenth, eleventh and twelfth domain, and:

i) the tenth, eleventh and twelfth domains are each attached at a C-terminus to an N-terminus of the fourth, fifth, and sixth domains, respectively, and each are a binding domain of a protein or a portion or modified version thereof, preferably a binding domain of a secreted protein, an extracellular domain of a transmembrane protein, or an antibody or portion thereof, more preferably a single-chain moiety of an antibody, more preferably a single-chain or single domain antibody molecules, more preferably an scFv domain;

ii) the fourth, fifth, and sixth are each a transmembrane domain, preferably a transmembrane domain of TNFSF1, TNFSF2, TNFSF3, TNFSF4, TNFSF5, TNFSF6, TNFSF7, TNFSF8, TNFSF9, TNFSF10, TNFSF11, TNFSF12, TNFSF13, TNFSF13B, TNFSF14, TNFSF15 or TNFSF18, more preferably a transmembrane domain of ACE2, Collectrin, CD8a, CD8b, CD3 zeta, CD3 epsilon, CD28, ICOS, OX40, 4-1BB, TNFRSF1, TNFRSF1B, LTBR, CD40, FasR, DCR3, CD27, CD30, DR4, DR5, DCR2, RANK, TWEAK-R, TACI, BAF-R, HVEM, BCMA, GITR, TROY, DR3, or XEDAR; and iii) the first, second, and third domains are each an antigen or neo-antigen; or nn) the octahedral molecule comprises a first, second, third, fourth, fifth, sixth, tenth, eleventh and twelfth domain, and the tenth, eleventh and twelfth domains are each attached at a C-terminus to an N-terminus of the fourth, fifth, and sixth domains, respectively, and each are an scFv domain, the fourth, fifth, and sixth are each a transmembrane domain of ACE2, Collectrin, CD8a, CD8b, CD3 zeta, CD3 epsilon, CD28, ICOS, OX40 or 4-1BB, and the first, second, and third domains are each an antigen or neo-antigen.

In embodiments of the invention that comprise transmembrane domains as the first, second, and third domains, preferably the octahedral molecule comprises first, second, and third trimerizing polypeptides that are naturally associated with said transmembrane domains. For example, if the first, second, and third domains are transmembrane domains of TNFSF1, the first, second, and third trimerizing polypeptides are extracellular domains of TNFSF1.

In preferred embodiments of any one of the embodiments of the octahedral molecule of the invention, in particular in any one of the embodiments of the preceding eight paragraphs the first, second, and third domains are each transmembrane domains. Alternatively, in preferred embodiments of any one of the embodiments of the octahedral molecule of the invention, in particular in any one of the embodiments of the preceding seven paragraphs the fourth, fifth, and sixth domains are each transmembrane domains.

Tetrahedral and Octahedral Antibodies or Molecules

In embodiments of the invention:

a) one or more of the first, second, third, fourth, fifth, sixth, seventh, and eighth domains of the tetrahedral antibody or molecule, or one or more of the first, second, third, fourth, fifth, sixth domains, seventh, eighth, ninth, tenth, eleventh, and twelfth domains of the octahedral antibody or molecule are Fc domains, wherein the one or more Fc domains are independently selected from any of the Fc domains disclosed herein, b) one or more of the first, second, third, fourth, fifth, sixth, seventh and eighth domains of the tetrahedral antibody or molecule, or one or more of the first, second, third, fourth, fifth, sixth domains, seventh, eighth, ninth, tenth, eleventh, and twelfth domains of the octahedral antibody or molecule are Fab domains, wherein the one or more Fab domains are independently selected from any of the Fab domains disclosed herein, c) one or more of the third, fourth, fifth, sixth, seventh, and eighth domains of the tetrahedral antibody or molecule, or one or more of the fourth, fifth, sixth, seventh, eighth, ninth, tenth, eleventh, and twelfth domains of the octahedral antibody or molecule are a secreted protein, wherein the one or more secreted protein are independently selected from any of the secreted proteins disclosed herein, d) one or more of the third, fourth, fifth, sixth, seventh, and eighth domains of the tetrahedral antibody or molecule, or one or more of the fourth, fifth, sixth, seventh, eighth, ninth, tenth, eleventh, and twelfth domains of the octahedral antibody or molecule are extracellular domains of a transmembrane protein, wherein the one or more extracellular domains of a transmembrane protein are independently selected from any of the extracellular domains of a transmembrane protein disclosed herein, e) one or more of the third, fourth, fifth, sixth, seventh, and eighth domains of the tetrahedral or one or more of the fourth, fifth, sixth, seventh, eighth, ninth, tenth, eleventh, and twelfth domains of the octahedral antibody or molecule:

i) comprise the structure of a compound that is a drug approved for treating a subject afflicted with a disease;

ii) comprise the structure of an organic compound having a molecular weight less than 1000 Daltons, a DNA aptamer, an RNA aptamer, an oligonucleotide, or a protein that is biologically active;

iii) comprise a primary or a secondary amine;

iv) are aripiprazole or oseltamivir;

v) are a respiratory drug, an antiasthmatic agent, an analgesic agent, an antidepressant, an antianginal agent, an antiarrhythmic agent, an antihypertensive agent, an antidiabetic agent, an antihistamine, an anti-infective agent, an antibiotic, an antiinflammatory agent, an antiparkinsonism drug, an antipsychotics, an antipyretic agent, an antiulcer agent, an attention deficit hyperactivity disorder (ADHD) drug, a central nervous system stimulant, a decongestant, or a psychostimulant;

vi) are alprenolol, acebutolol, amidephrine, amineptine, amosulalol, amoxapine, amphetaminil, atenolol, atomoxetine, balofloxacin, bamethan, benazepril, befunolol, benfluorex, benzoctamine, betahistine, betaxolol, bevantolol, bifemelane, bisoprolol, brinzolamide, bufeniode, butethamine, camylofine, carazolol, carticaine, carvedilol, cephaeline, ciprofloxacin, cloZapine, clobenZorex, clorprenaline, cyclopentamine, delapril, demexiptiline, denopamine, desipramine, desloratadine, diclofenac, dimetofrine, dioxadrol, dobutamine, dopexamine, doripenem, dorzolamide, droprenilamine, duloxetine, eltopraZine, enalapril, enoxacin, epinephrine, ertapenem, esapraZole, esmolol, etoxadrol, fasudil, fendiline, fenethylline, fenfluramine, fenoldopam, fenoterol, fenproporex, flecamide, fluoxetine, formoterol, frovatriptan, gaboxadol, garenoxacin, gatifloxacin, grepafloxacin, hexoprenaline, imidapril, indalpine, indecainide, indeloxazine hydrochloride, isoxsuprine, ispronicline, labetalol, landiolol, lapatinib, levophacetoperane, lisinopril, lomefloxacin, lotrafiban, maprotiline, mecamylamine, mefloquine, mepindolol, meropenem, metapramine, metaproterenol, methoxyphenamine, dextrorotary methylphenidate, methylphenidate, metipranolol, metoprolol, mitoxantrone, mivazerol, moexipril, moprolol, moxifloxacin, nebivolol, nifenalol, nipradilol, norfloxacin, nortriptyline, nylidrin, olanZapine, oxamniquine, oxprenolol, oxyfedrine, paroxetine, perhexyline, phenmetrazine, phenylephrine, phenylpropylmethylamine, pholedrine, picilorex, pimethylline, pindolol, pipemidic acid, piridocaine, practolol, pradofloxacin, pramipexole, pramiverin, prenalterol, prenylamine, prilocalne, procaterol, pronethalol, propafenone, propranolol, propylhexedrine, protokylol, protriptyline, pseudoephedrine, reboxetine, rasagiline, (r)-rasagiline, repinotan, reproterol, rimiterol, ritodrine, safinamide, salbutamol/albuterol, salmeterol, sarizotan, sertraline, silodosin, sotalol, soterenol, sparfloxacin, spirapril, sulfinalol, synephrine, tamsulosin, tebanicline, tianeptine, tirofiban, tretoquinol, trimetazidine, troxipide, varenicline, vildagliptin, viloxazine, viquidil or xamoterol;

vii) comprise a protein that is biologically active;

viii) are biologically active such that it has target-binding activity;

ix) are an independently-folding protein or a portion thereof;

x) are a glycosylated protein;

xi) comprise intra-chain disulfide bonds;

xii) binds a cytokine;

xiii) binds to a cytokine, wherein the cytokine is TNFα;

xiv) comprise Atrial Natriuretic Peptide (ANP), Calcitonin, Corticotropin Releasing Hormone (CRH), Endothelin, Exenatide, Gastric Inhibitory Peptide (GIP), Glucagon-Like Peptide-1 (GLP-1), Glucagon-Like Peptide-2 (GLP-2), an analog of GLP-1 or GLP-2, Glucagon Vasoactive Intestinal Peptide (GVIP), Ghrelin, Peptide YY or Secretin, or a portion thereof;

xv) comprise a stretch of consecutive amino acids in the sequence HGEGTFTSDVSSYLEEQAAKEFIAWLVKGRG (SEQ ID NO: 4657);

xvi) comprise at least one stretch of consecutive amino acids which are identical to a stretch of consecutive amino acids present in the heavy chain of a Fab or a Fab' of an antibody;

xvii) comprise at least one at least one stretch of consecutive amino acids which are identical to a stretch of consecutive amino acids present in the light chain of a Fab or a Fab' of an antibody;

xviii) comprise at least one Fab or Fab' of an antibody, or a portion of at least one Fab or Fab';

xix) comprise Fab-1 or Fab'1, or a portion thereof of an antibody;

XX) comprise Fab-2 or Fab'2, or a portion thereof of an antibody;

xxi) comprise two Fab or Fab' hands of an antibody;

xxii) comprise at least one stretch of consecutive amino acids which are identical to a stretch of consecutive amino acids present in a single chain antibody; or xxiii) comprise at least one stretch of consecutive amino acids which are identical to a stretch of consecutive amino acids present in a TNFα receptor.

f) the tetrahedral or octahedral antibody comprises a covalent linkage, wherein the covalent linkage is selected from any covalent linkage disclosed herein, or comprises any heterobifunctional crosslinker disclosed herein; and/or g) the tetrahedral or octahedral antibody or molecule comprises one or more peptide linkers, wherein the one or more peptide linkers are independently selected from:

i) a stretch of consecutive amino acids which is, or is present in, the sequence TSTSPTRSMAPGAVHLPQPVSTRSQHTQPTPEPSTAPS TSFLLPMGPSPPAEGSTGD (SEQ ID NO: 3227);

ii) a stretch of consecutive amino acids which is, or is present in, the sequence GGGGAGGGGAGGGGAGGGGAGGGGAGGG (SEQ ID NO: 226), or iii) any peptide linker disclosed herein.

FIGS. 1-14 and 29A to 42 schematically describe various non-limiting examples of tetrahedral and octahedral antibodies of the invention. A description of the various types of domains of these tetrahedral and octahedral antibodies (as represented by ovals or groups of ovals in various colors and/or patterns) is provided in the Brief Description of the Drawings. Each figure represents an embodiment of the invention. Further, the Examples of this application provide specific tetrahedral antibodies, each of which is an embodiment of the invention. This invention contemplates producing variants of each of these specific tetrahedral antibodies. Specifically, where a tetrahedral antibody disclosed in the Examples includes a mutant or modified sequence, this invention specifically contemplates a variant which replaces the mutant or modified sequence with a wild type sequence. Conversely, this invention specifically contemplates modifying any of the tetrahedral antibody by replacing a wild-type sequence, if present, with a mutant counterpart sequence comprising any of the relevant mutations described herein.

This invention also provides a composition comprising at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% of the tetrahedral or octahedral antibody of the invention, as a proportion (w/w) of peptide-containing molecules in the composition.

Methods of Making

This invention also provides a method of making a tetrahedral antibody of the invention which comprises four domains, wherein the non-peptidyl linkage of the tetrahedral antibody is a non-covalent linkage between a first dimerizing polypeptide attached to the first N-terminus of first domain and a second dimerizing polypeptide attached to the first N-terminus of the second domain, the method comprising:

a) recombinantly expressing each of the following polypeptides in a host cell:
  i) a first polypeptide comprising, from its N-terminus to its C-terminus,
    (1) optionally, the third domain, which is attached at its C-terminus by a peptide bond or via a peptide linker to
    (2) the N-terminus of the first dimerizing polypeptide, which is attached at its C-terminus by a peptide bond or via a peptide linker to
    (3) the N-terminus of the first polypeptide chain of the first domain,
  ii) a second polypeptide comprising, from its N-terminus to its C-terminus,
    (1) optionally, the fourth domain, which is attached at its C-terminus by a peptide bond or via a peptide linker to
    (2) the N-terminus of the second dimerizing polypeptide, which is attached at its C-terminus by a peptide bond or via a peptide linker to
    (3) the N-terminus of the first polypeptide chain of the second domain,
  iii) a third polypeptide comprising, from its N-terminus to its C-terminus,
    (1) the third domain if not present on the first polypeptide, which is attached at its C-terminus by a peptide bond or via a peptide linker to
      a. the N-terminus of a third dimerizing polypeptide which is in turn attached at its C-terminus by a peptide bond or via a peptide linker to the N-terminus of the second polypeptide chain of the first domain, or
      b. the N-terminus of the second polypeptide chain of the first domain,
  iv) a fourth polypeptide comprising, from its N-terminus to its C-terminus,
    (1) the fourth domain if not present on the second polypeptide, which is attached at its C-terminus by a peptide bond or via a peptide linker to
      a. the N-terminus of a fourth dimerizing polypeptide which is in turn attached at its C-terminus by a peptide bond or via a peptide linker to the N-terminus of the second polypeptide chain of the first domain, or
      b. the N-terminus of the second polypeptide chain of the first domain, and
  v) optionally one or more additional polypeptides comprising a second polypeptide chain of the third and/or fourth domains, if present.

This invention also provides a method of making a tetrahedral antibody of the invention which comprises four domains, wherein the non-peptidyl linkage of the tetrahedral antibody is a non-covalent linkage between a first dimerizing polypeptide attached to the first C-terminus of first domain and a second dimerizing polypeptide attached to the first N-terminus of the second domain, the method comprising:

a) recombinantly expressing each of the following polypeptides in a host cell:
  i) a first polypeptide comprising, from its N-terminus to its C-terminus,
    (1) the first polypeptide chain of the first domain which is attached at its C-terminus by a peptide bond or via a peptide linker to
    (2) the N-terminus of the first dimerizing polypeptide, which is in turn optionally attached at its C-terminus by a peptide bond or via a peptide linker to
    (3) the N-terminus of the third domain,
  ii) a second polypeptide comprising, from its N-terminus to its C-terminus,
    (1) optionally, the fourth domain which is attached at its C-terminus by a peptide bond or via a peptide linker to
    (2) the N-terminus of the second dimerizing polypeptide which is attached at its C-terminus by a peptide bond or via a peptide linker to
    (3) the N-terminus of the first polypeptide chain of the second domain,
  iii) a third polypeptide comprising, from its N-terminus to its C-terminus,
    (1) the second polypeptide chain of the first domain, which is attached at its C-terminus by a peptide bond or via a peptide linker to a. the N-terminus of a third dimerizing polypeptide which is in turn attached at its C-terminus by a peptide bond or via a peptide linker to the N-terminus of the third domain if not present on the first polypeptide, or b. the N-terminus of the third domain if not present on the first polypeptide, iv) a fourth polypeptide comprising, from its N-terminus to its C-terminus, (1) the fourth domain if not present on the second polypeptide, which is attached at its C-terminus by a peptide bond or via a peptide linker to a. the N-terminus of a fourth dimerizing polypeptide which is in turn attached at its C-terminus by a peptide bond or via a peptide linker to the N-terminus of the second polypeptide chain of the first domain, or b. the N-terminus of the second polypeptide chain of the first domain, and v) optionally one or more additional polypeptides comprising a second polypeptide chain of the third and/or fourth domains, if present.

This invention also provides a method of making a tetrahedral antibody of the invention which comprises four domains, wherein the non-peptidyl linkage of the tetrahedral antibody is a non-covalent linkage between a first dimerizing polypeptide attached to the first N-terminus of first domain and a second dimerizing polypeptide attached to the first C-terminus of the second domain, the method comprising:

a) recombinantly expressing each of the following polypeptides in a host cell:

i) a first polypeptide comprising, from its N-terminus to its C-terminus, (1) optionally, the third domain attached at its C-terminus by a peptide bond or via a peptide linker to (2) the N-terminus of the first dimerizing polypeptide attached at its C-terminus by a peptide bond or via a peptide linker to (3) the N-terminus of the first polypeptide chain of the first domain, ii) a second polypeptide comprising, from its N-terminus to its C-terminus, (1) the first polypeptide chain of the second domain attached at its C-terminus by a peptide bond or via a peptide linker to (2) the N-terminus of the second dimerizing polypeptide, which is in turn optionally attached at its C-terminus by a peptide bond or via a peptide linker to (3) the N-terminus of the third domain, iii) a third polypeptide comprising, from its N-terminus to its C-terminus, (1) the third domain if not present on the first polypeptide, attached at its C-terminus by a peptide bond or via a peptide linker to a. the N-terminus of a third dimerizing polypeptide which is in turn attached at its C-terminus by a peptide bond or via a peptide linker to the N-terminus of the second polypeptide chain of the first domain, or b. the N-terminus of the second polypeptide chain of the first domain, iv) a fourth polypeptide comprising, from its N-terminus to its C-terminus, (1) the second polypeptide chain of the first domain, which is attached at its C-terminus by a peptide bond or via a peptide linker to a. the N-terminus of a fourth dimerizing polypeptide which is in turn attached at its C-terminus by a peptide bond or via a peptide linker to the N-terminus of the fourth domain if not present on the second polypeptide, or b. the N-terminus of the fourth domain if not present on the second polypeptide, and v) optionally one or more additional polypeptides comprising a second polypeptide chain of the third and/or fourth domains, if present.

This invention also provides a method of making a tetrahedral antibody of the invention which comprises four domains, wherein the non-peptidyl linkage of the tetrahedral antibody is a non-covalent linkage between a first dimerizing polypeptide attached to the first C-terminus of first domain and a second dimerizing polypeptide attached to the first C-terminus of the second domain, the method comprising:

a) recombinantly expressing each of the following polypeptides in a host cell:

i) a first polypeptide comprising, from its N-terminus to its C-terminus, (1) the first polypeptide chain of the first domain which is attached at its C-terminus by a peptide bond or via a peptide linker to (2) the N-terminus of the first dimerizing polypeptide, which is in turn optionally attached at its C-terminus by a peptide bond or via a peptide linker to (3) the N-terminus of the third domain, ii) a second polypeptide comprising, from its N-terminus to its C-terminus, (1) the first polypeptide chain of the second domain attached at its C-terminus by a peptide bond or via a peptide linker to (2) the N-terminus of the second dimerizing polypeptide, which is in turn optionally attached at its C-terminus by a peptide bond or via a peptide linker to (3) the N-terminus of the third domain, iii) a third polypeptide comprising, from its N-terminus to its C-terminus, (1) the second polypeptide chain of the first domain, which is attached at its C-terminus by a peptide bond or via a peptide linker to a. the N-terminus of a third dimerizing polypeptide which is in turn attached at its C-terminus by a peptide bond or via a peptide linker to the N-terminus of the third domain if not present on the first polypeptide, or b. the N-terminus of the third domain if not present on the first polypeptide, iv) a fourth polypeptide comprising, from its N-terminus to its C-terminus, (1) the second polypeptide chain of the first domain, which is attached at its C-terminus by a peptide bond or via a peptide linker to a. the N-terminus of a fourth dimerizing polypeptide which is in turn attached at its C-terminus by a peptide bond or via a peptide linker to the N-terminus of the fourth domain if not present on the second polypeptide, or b. the N-terminus of the fourth domain if not present on the second polypeptide, and v) optionally one or more additional polypeptides comprising a second polypeptide chain of the third and/or fourth domains, if present.

This invention also provides a method of making a tetrahedral antibody of the invention which comprises a fifth and/or sixth domain, wherein the non-peptidyl linkage of the tetrahedral antibody is a non-covalent linkage between a first dimerizing polypeptide attached to the first N-terminus of first domain and a second dimerizing polypeptide attached to the first N-terminus of the second domain, the method comprising:

a) recombinantly expressing each of the following polypeptides in a host cell:
   i) a first polypeptide comprising, from its N-terminus to its C-terminus,
      (1) the third domain, or fifth domain if present, which is attached at its C-terminus by a peptide bond or via a peptide linker to
      (2) the N-terminus of the first dimerizing polypeptide, which is attached at its C-terminus by a peptide bond or via a peptide linker to
      (3) the N-terminus of the first polypeptide chain of the first domain,
   ii) a second polypeptide comprising, from its N-terminus to its C-terminus,
      (1) the fourth domain, or sixth domain if present, which is attached at its C-terminus by a peptide bond or via a peptide linker to
      (2) the N-terminus of the second dimerizing polypeptide which is attached at its C-terminus by a peptide bond or via a peptide linker to
      (3) the N-terminus of the first polypeptide chain of the second domain,
   iii) a third polypeptide comprising, from its N-terminus to its C-terminus,
      (1) the third domain if not present on the first polypeptide, or the fifth domain if present, which is attached at its C-terminus by a peptide bond or via a peptide linker to
         a. the N-terminus of a third dimerizing polypeptide which is in turn attached at its C-terminus by a peptide bond or via a peptide linker to the N-terminus of the second polypeptide chain of the first domain, or
         b. the N-terminus of the second polypeptide chain of the first domain,
   iv) a fourth polypeptide comprising, from its N-terminus to its C-terminus,
      (1) the fourth domain if not present on the second polypeptide, or the sixth domain if present, which is attached at its C-terminus by a peptide bond or via a peptide linker to
         a. the N-terminus of a fourth dimerizing polypeptide which is in turn attached at its C-terminus by a peptide bond or via a peptide linker to the N-terminus of the second polypeptide chain of the first domain, or
         b. the N-terminus of the second polypeptide chain of the first domain, and
v) optionally one or more additional polypeptides comprising a second polypeptide chain of the third, fourth, fifth, and/or sixth domains, if present.

This invention also provides a method of making a tetrahedral antibody of the invention which comprises a fifth and/or sixth domain, wherein the non-peptidyl linkage of the tetrahedral antibody is a non-covalent linkage between a first dimerizing polypeptide attached to the first C-terminus of first domain and a second dimerizing polypeptide attached to the first N-terminus of the second domain, the method comprising:

a) recombinantly expressing each of the following polypeptides in a host cell:
   i) a first polypeptide comprising, from its N-terminus to its C-terminus,
      (1) the first polypeptide chain of the first domain which is attached at its C-terminus by a peptide bond or via a peptide linker to
      (2) the N-terminus of the first dimerizing polypeptide which is attached at its C-terminus by a peptide bond or via a peptide linker to
      (3) the N-terminus of the third domain, or fifth domain if present,
   ii) a second polypeptide comprising, from its N-terminus to its C-terminus,
      (1) the fourth domain, or sixth domain if present, which is attached at its C-terminus by a peptide bond or via a peptide linker to
      (2) the N-terminus of the second dimerizing polypeptide which is attached at its C-terminus by a peptide bond or via a peptide linker to
      (3) the N-terminus of the first polypeptide chain of the second domain,
   iii) a third polypeptide comprising, from its N-terminus to its C-terminus,
      (1) the second polypeptide chain of the first domain which is attached at its C-terminus by a peptide bond or via a peptide linker to
         a. the N-terminus of a third dimerizing polypeptide which is in turn attached at its C-terminus by a peptide bond or via a peptide linker to the N-terminus of the third domain if not present on the first polypeptide, or the fifth domain if present, or
         b. the N-terminus of the third domain if not present on the first polypeptide, or the fifth domain if present,
   iv) a fourth polypeptide comprising, from its N-terminus to its C-terminus,
      (1) the fourth domain if not present on the second polypeptide, or the sixth domain if present, which is attached at its C-terminus by a peptide bond or via a peptide linker to
         a. the N-terminus of a fourth dimerizing polypeptide which is in turn attached at its C-terminus by a peptide bond or via a peptide linker to the N-terminus of the second polypeptide chain of the first domain, or
         b. the N-terminus of the second polypeptide chain of the first domain, and
   v) optionally one or more additional polypeptides comprising a second polypeptide chain of the third, fourth, fifth, and/or sixth domains, if present.

This invention also provides a method of making a tetrahedral antibody of the invention which comprises a fifth and/or sixth domain, wherein the non-peptidyl linkage of the tetrahedral antibody is a non-covalent linkage between a first dimerizing polypeptide attached to the first N-terminus of first domain and a second dimerizing polypeptide attached to the first C-terminus of the second domain, the method comprising:

a) recombinantly expressing each of the following polypeptides in a host cell:
   i) a first polypeptide comprising, from its N-terminus to its C-terminus, (1) the third domain, or fifth domain if present, which is attached at its C-terminus by a peptide bond or via a peptide linker to (2) the N-terminus of the first dimerizing polypeptide which is attached at its C-terminus by a peptide bond or via a peptide linker to (3) the N-terminus of the first polypeptide chain of the first domain, ii) a second polypeptide comprising, from its N-terminus to its C-terminus, (1) the first polypeptide chain of the second domain which is attached at its C-terminus by a peptide bond or via a peptide linker to (2) the N-terminus of the second dimerizing polypeptide which is attached at its C-terminus by a peptide bond or via a peptide linker to (3) the N-terminus of the fourth domain, or sixth domain if present, iii) a third polypeptide comprising, from its N-terminus to its C-terminus, (1) the third domain if not present on the first polypeptide, or the fifth domain if present, attached at its C-terminus by a peptide bond or via a peptide linker to a. the N-terminus of a third dimerizing polypeptide which is in turn attached at its C-terminus by a peptide bond or via a peptide linker to the N-terminus of the second polypeptide chain of the first domain, or b. the N-terminus of the second polypeptide chain of the first domain, and iv) a fourth polypeptide comprising, from its N-terminus to its C-terminus, (1) the second polypeptide chain of the first domain, which is attached at its C-terminus by a peptide bond or via a peptide linker to a. the N-terminus of a fourth dimerizing polypeptide which is in turn attached at its C-terminus by a peptide bond or via a peptide linker to the N-terminus of the fourth domain if not present on the second polypeptide, or the sixth domain if present, or b. the N-terminus of the fourth domain if not present on the second polypeptide, or the sixth domain if present, and v) optionally one or more additional polypeptides comprising a second polypeptide chain of the third, fourth, fifth, and/or sixth domains, if present.

This invention also provides a method of making a tetrahedral antibody of the invention which comprises a fifth and/or sixth domain, wherein the non-peptidyl linkage of the tetrahedral antibody is a non-covalent linkage between a first dimerizing polypeptide attached to the first C-terminus of first domain and a second dimerizing polypeptide attached to the first C-terminus of the second domain, the method comprising:

a) recombinantly expressing each of the following polypeptides in a host cell:

i) a first polypeptide comprising, from its N-terminus to its C-terminus, (1) the first polypeptide chain of the first domain which is attached at its C-terminus by a peptide bond or via a peptide linker to (2) the N-terminus of the first dimerizing polypeptide which is attached at its C-terminus by a peptide bond or via a peptide linker to (3) the N-terminus of the third domain, or fifth domain if present, ii) a second polypeptide comprising, from its N-terminus to its C-terminus, (1) the first polypeptide chain of the second domain which is attached at its C-terminus by a peptide bond or via a peptide linker to (2) the N-terminus of the second dimerizing polypeptide which is attached at its C-terminus by a peptide bond or via a peptide linker to (3) the N-terminus of the fourth domain, or sixth domain if present, iii) a third polypeptide comprising, from its N-terminus to its C-terminus, (1) the second polypeptide chain of the first domain which is attached at its C-terminus by a peptide bond or via a peptide linker to a. the N-terminus of a third dimerizing polypeptide which is in turn attached at its C-terminus by a peptide bond or via a peptide linker to the N-terminus of the third domain if not present on the first polypeptide, or the fifth domain if present, or b. the N-terminus of the third domain if not present on the first polypeptide, or the fifth domain if present, and iv) a fourth polypeptide comprising, from its N-terminus to its C-terminus, (1) the second polypeptide chain of the first domain, which is attached at its C-terminus by a peptide bond or via a peptide linker to a. the N-terminus of a fourth dimerizing polypeptide which is in turn attached at its C-terminus by a peptide bond or via a peptide linker to the N-terminus of the fourth domain if not present on the second polypeptide, or the sixth domain if present, or b. the N-terminus of the fourth domain if not present on the second polypeptide, or the sixth domain if present, and c. optionally one or more additional polypeptides comprising a second polypeptide chain of the third, fourth, fifth, and/or sixth domains, if present.

Domains

The domains of the tetrahedral and octahedral antibodies are numbered herein to facilitate description and identification of each domain. The first domain may be referred to herein as "D1," or "domain 1." The same principle applies to all other domains of the inventions (i.e. the second domain may be referred to herein as "D2" or "domain 2," etc.). Further, unless specified otherwise, the tetrahedral antibodies of the invention may lack one or more domains without affecting the numbering of the other domains. For example, a tetrahedral antibody of the invention may comprise domains 1, 2, 3, 4, and 6 without comprising a domain 5. As another example, a tetrahedral antibody of the invention may comprise domains 1, 2, 3, 4, 7, and 8 without comprising domains 5 and 6 (see, e.g., FIG. 42).

In principle, the first and second domains of the tetrahedral antibodies of the invention are interchangeable, i.e. a feature that is described as applying to the first domain can equally apply to the second domain in some embodiments. Similarly, the third and fourth domains of the tetrahedral antibodies of the invention are interchangeable, the fifth and sixth domains of the invention are interchangeable and the seventh and eighth domains are interchangeable.

Similarly, with respect to octahedral antibodies of the invention, the first, second, and third domains of the invention are interchangeable, the fourth, fifth, and sixth domains are interchangeable, the seventh, eight, and ninth domains are interchangeable, and the tenth, eleventh and twelfth domains are interchangeable. As discussed above, in this context interchangeable means that any feature described herein as applying to one of the domains, may also apply to any of the other domains.

In the same way, a person of skill in the art will appreciate that domains 1 and 2 of the tetrahedral antibodies of the invention and domains 1, 2 and 3 of the octahedral antibodies of the invention serve a similar structural purpose and are therefore equivalent insofar as any description applying to domains 1 and 2 of tetrahedral antibodies of the invention may also apply to domains 1, 2, and 3 of octahedral antibodies of the invention. A similar equivalence applies as between domains 3 and 4 of the tetrahedral antibodies of the invention and domains 4, 5, and 6 of the octahedral antibodies of the invention. Further, a similar equivalence applies as between domains 5 and 6 of the tetrahedral antibodies of the invention and domains 7, 8 and 9 of the octahedral antibodies of the invention. Still further, a similar equivalence applies as between domains 7 and 8 of the tetrahedral antibodies of the invention and domains 10, 11 and 12 of the octahedral antibodies of the invention.

Chains

Various embodiments of the invention comprise domains which are made up of "heavy chains" and "light chains." Heavy chains of the invention may be referred to herein as "H Chain," or "H1," "H2," "H3," etc. Similarly, light chains of the invention may be referred to herein as "L Chain," or "L1," "L2," "L3," etc. Each of these chains is an embodiment of the invention. Further, each of these chains when bound to their corresponding heavy or light chain is an embodiment of the invention.

In embodiments of the tetrahedral antibody of the invention comprise a first heavy chain ("H1") and a second heavy chain ("H2"). H1 and H2 chains may pair with one another to form domains 1 and 2. H1 may also pair with a light chain to form domains 3 and 4, while H2 may also pair with a light chain to form domains 5 and 6. H1 and H2 chains may also homodimerize. In such cases, a dimerizing polypeptide on the H1 chain heterodimerizes with a dimerizing polypeptide on the H2 chain. The H1 or H2 chains may also comprise additional domains 7 and 8 as described herein. The H1 and/or H2 chains may also comprise a dimerizing polypeptide between domains 1 and 3 and/or between domains 2 and 4. In each of the tetrahedral antibodies of the invention, the H1 and H2 chains may comprise one or more peptide linkers. If the H1 and/or H2 chains comprise a dimerizing polypeptide the peptide linker may be present between either domain 1 or 2 and the dimerizing polypeptide, between the dimerizing polypeptide and domain 3 or 4, or both. A peptide linker may also be present between either domain 1 or 2 and the dimerizing polypeptide, between the dimerizing polypeptide and domain 5 or 6, or both.

A similar principle applies to octahedral antibody of invention. H1 and H2 chains pair with one another to form domains 1, 2 and 3. H1 may also pair with a light chain to form domains 4, 5, and 6, while H2 may pair with a light chain to form domains 7, 8, and 9. The H1 or H2 chains may also comprise additional domains 10, 11 and 12 as described herein.

Various embodiments of the invention comprise Fc fusion proteins. In such embodiments, part of an "Fc fusion chain" may pair with an "Fc chain" to form an Fc domain. Fc domains of the invention are typically domains 1 and/or 2 of the tetrahedral antibodies of the invention and domains 1, 2, and/or 3 of the octahedral antibodies of the invention. The "Fc fusion chains" typically also comprise a portion which forms domains 3, 4, 5, and/or 6 of the tetrahedral antibodies of the invention and domains 4, 5, 6, 7, 8, 9, 10, 11, and/or 12 of the octahedral antibodies of the invention.

In tetrahedral antibodies of the invention, the "Fc fusion chain" may include a dimerizing polypeptide between the portions forming part of domains 1 and 2 and the portions forming domains 3 and 4. In an alternative embodiment, the "Fc fusion chain" can lack a dimerizing polypeptide because the "Fc chain" of domains 1 and 2 each include a dimerizing polypeptide at their respective N-termini. In an alternative of this embodiment, the "Fc chain" of domains 1 and 2 are linked at their respective N-termini by a covalent linkage.

This invention specifically contemplates tetrahedral and octahedral antibodies wherein (1) the "Fc fusion chain" includes a dimerizing polypeptide between the portions forming part of domains 1 and 2 and the portions forming domains 3 and 4 and (2) domains 3 and 4 are not an ACE2 peptidase domain.

In octahedral antibodies of the invention, the "Fc fusion chain" may comprise a trimerizing polypeptide between the portions forming part of domains 1, 2, and 3, and the portion forming domains 4, 5, and 6.

In each of the tetrahedral antibodies of the invention, the "Fc fusion chain" may comprise one or more peptide linkers between the portion forming part of domain 1 and the portion forming domains 3 or 5. If the "Fc fusion chain" comprises a dimerizing polypeptide the peptide linker may be present between either domain 1 and the dimerizing polypeptide, between the dimerizing polypeptide and domain 3 or 5, or both. Similarly, the "Fc fusion chain" may comprise a peptide linker between the portion forming part of domain 2 and the portion forming domain 4, or 6. If the "Fc fusion chain" comprises a dimerizing polypeptide the peptide linker may be present between either domain 2 and the dimerizing polypeptide, between the dimerizing polypeptide and domain 4 or 6, or both.

In each of the octahedral antibodies of the invention, the "Fc fusion chain" may comprise a peptide linker between the portion forming part of domain 1 and the portion forming domain 4 or 7, between the portion forming part of domain 2 and the portion forming domain 5 or 8, and between the portion forming part of domain 3 and the portion forming domain 6 or 9. In each such case, if the "Fc fusion chain" comprises a trimerizing polypeptide, then the "Fc fusion chain" may comprise a peptide linker either between the portion forming part of domains 1, 2, and 3 and the trimerizing polypeptide, between the trimerizing polypeptide and the portion forming domains 4, 5, and 6, or both.

Terms

As used herein, and unless stated otherwise, each of the following terms shall have the definition set forth below.

Peptidyl linkage: the structure

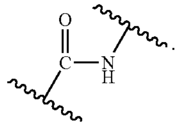 [SMILES: *NC(*)=O]

A peptidyl linkage may be a peptide bond.

Stretch of consecutive amino acids: a plurality of amino acids arranged in a chain, each of which is joined to a preceding amino acid by a peptide bond, excepting that the first amino acid in the chain may optionally not be joined to a preceding amino acid. The amino acids of the chain may be naturally or non-naturally occurring, or may comprise a mixture thereof. The amino acids, unless otherwise indicated, may be genetically encoded, naturally-occurring but not genetically encoded, or non-naturally occurring, and any selection thereof.

N-terminal amino acid residue: the terminal residue of a stretch of two or more consecutive amino acids having a free α-amino ($NH_2$) functional group, or a derivative of an α-amino ($NH_2$) functional group.

N-terminus: the free α-amino ($NH_2$) group (or derivative thereof) of an N-terminal amino acid residue.

C-terminal amino acid residue: the terminal residue of a stretch of two or more consecutive amino acids having a free α-carboxyl (COOH) functional group, or a derivative of a α-carboxyl (COOH) functional group.

C-terminus: the free α-carboxyl (COOH) group (or derivative thereof) of a C-terminal amino acid residue.

A "biologically active structure", as used herein, means a structure of a molecule or fragment thereof, capable of treating a disease or condition or localizing or targeting a compound of the invention to a site of a disease or condition in the body by performing a function or an action, or stimulating or responding to a function, an action or a reaction, in a biological context (e.g. in an organism, a cell, or an in vitro model thereof). Biologically active structures may comprise a structure of at least one of polypeptides, nucleic acids, small molecules such as small organic or inorganic molecules.

A "bond", unless otherwise specified, or contrary to context, is understood to include a covalent bond, a dipole-dipole interaction such as a hydrogen bond, and intermolecular interactions such as van der Waals forces.

A "Signal Sequence" is a short (3-60 amino acids long) peptide chain that directs the post-translational transport of a polypeptide.

"Amino acid" as used herein, in one embodiment, means a L or D isomer of the genetically encoded amino acids, i.e. isoleucine, alanine, leucine, asparagine, lysine, aspartate, methionine, cysteine, phenylalanine, glutamate, threonine, glutamine, tryptophan, glycine, valine, proline, arginine, serine, histidine, tyrosine, selenocysteine, pyrrolysine and also includes homocysteine and homoselenocysteine.

Other examples of amino acids include an L or D isomer of taurine, gaba, dopamine, lanthionine, 2-aminoisobutyric acid, dehydroalanine, ornithine and citrulline, as well as non-natural homologues and synthetically modified forms thereof including amino acids having alkylene chains shortened or lengthened by up to two carbon atoms, amino acids comprising optionally substituted aryl groups, and amino acids comprising halogenated groups, including halogenated alkyl and aryl groups as well as beta or gamma amino acids, and cyclic analogs.

Due to the presence of ionizable amino and carboxyl groups, the amino acids in these embodiments may be in the form of acidic or basic salts, or may be in neutral forms. Individual amino acid residues may also be modified by oxidation or reduction. Other contemplated modifications include hydroxylation of proline and lysine, phosphorylation of hydroxyl groups of seryl or threonyl residues, and methylation of the alpha-amino groups of lysine, arginine, and histidine side chains.

Covalent derivatives may be prepared by linking particular functional groups to the amino acid side chains or at the N- or C-termini.

Compounds comprising amino acids with R-group substitutions are within the scope of the invention. It is understood that substituents and substitution patterns on the compounds of the instant invention can be selected by one of ordinary skill in the art to provide compounds that are chemically stable from readily available starting materials.

"Natural amino acid" as used herein means a L or D isomer of the genetically encoded amino acids, i.e. isoleucine, alanine, leucine, asparagine, lysine, aspartate, methionine, cysteine, phenylalanine, glutamate, threonine, glutamine, tryptophan, glycine, valine, proline, arginine, serine, histidine, tyrosine, selenocysteine, pyrrolysine and homocysteine and homoselenocysteine.

"Non-natural amino acid" as used herein means a chemically modified L or D isomer of isoleucine, alanine, leucine, asparagine, lysine, aspartate, methionine, cysteine, phenylalanine, glutamate, threonine, glutamine, tryptophan, glycine, valine, proline, arginine, serine, histidine, tyrosine, selenocysteine, pyrrolysine, homocysteine, homoselenocysteine, taurine, gaba, dopamine, lanthionine, 2-aminoisobutyric acid, dehydroalanine, ornithine or citrulline, including cysteine and selenocysteine derivatives having C3-C10 aliphatic side chains between the alpha carbon and the S or Se. In one embodiment the aliphatic side chain is an alkylene. In another embodiment, the aliphatic side chain is an alkenylene or alkynylene.

In addition to the stretches of consecutive amino acid sequences described herein, it is contemplated that variants thereof can be prepared by introducing appropriate nucleotide changes into the encoding DNA, and/or by synthesis of the desired consecutive amino acid sequences. Those skilled in the art will appreciate that amino acid changes may alter post-translational processes of the stretches of consecutive amino acids described herein when expression is the chosen method of synthesis (rather than chemical synthesis for example), such as changing the number or position of glycosylation sites or altering the membrane anchoring characteristics.

Variations in the sequences described herein, can be made, for example, using any of the techniques and guidelines for conservative and non-conservative mutations set forth, for instance, in U.S. Pat. No. 5,364,934. Variations may be a substitution, deletion or insertion of one or more codons encoding the consecutive amino acid sequence of interest that results in a change in the amino acid sequence as compared with the native sequence. Optionally the variation is by substitution of at least one amino acid with any other amino acid in one or more of the domains. Guidance in determining which amino acid residue may be inserted, substituted or deleted without adversely affecting the desired activity may be found by comparing the sequence with that of homologous known protein molecules and minimizing the number of amino acid sequence changes made in regions of high homology. Amino acid substitutions can be the result of replacing one amino acid with another amino acid having similar structural and/or chemical properties, such as the replacement of a leucine with a serine, i.e., conservative amino acid replacements. Insertions or deletions may optionally be in the range of about 1 to 5 amino acids. The variation allowed may be determined by systematically making insertions, deletions or substitutions of amino acids in the sequence and testing the resulting variants for activity exhibited by the full-length or mature native sequence. It is understood that any terminal variations are made within the context of the invention disclosed herein.

Amino acid sequence variants of the binding partner are prepared with various objectives in mind, including increasing the affinity of the binding partner for its ligand, facilitating the stability, purification and preparation of the binding partner, modifying its plasma half life, improving therapeutic efficacy, and lessening the severity or occurrence of side effects during therapeutic use of the binding partner.

Amino acid sequence variants of these sequences are also contemplated herein including insertional, substitutional, or deletional variants. Such variants ordinarily can prepared by site-specific mutagenesis of nucleotides in the DNA encoding the target-binding monomer, by which DNA encoding the variant is obtained, and thereafter expressing the DNA in recombinant cell culture. Fragments having up to about 100-150 amino acid residues can also be prepared conveniently by in vitro synthesis. Such amino acid sequence variants are predetermined variants and are not found in nature. The variants exhibit the qualitative biological activity (including target-binding) of the nonvariant form, though not necessarily of the same quantitative value. While the site for introducing an amino acid sequence variation is predetermined, the mutation per se need not be predetermined. For example, in order to optimize the performance of a mutation at a given site, random or saturation mutagenesis (where all 20 possible residues are inserted) is conducted at the target codon and the expressed variant is screened for the optimal combination of desired activities. Such screening is within the ordinary skill in the art.

Amino acid insertions usually will be on the order of about from 1 to 10 amino acid residues; substitutions are typically introduced for single residues; and deletions will range about from 1 to 30 residues. Deletions or insertions preferably are made in adjacent pairs, i.e. a deletion of 2 residues or insertion of 2 residues. It will be amply apparent from the following discussion that substitutions, deletions, insertions or any combination thereof are introduced or combined to arrive at a final construct.

As used herein, "modification" means an amino acid substitution, insertion, and/or deletion in a polypeptide sequence or an alteration to a moiety chemically linked to a protein. For example, a modification may be an altered carbohydrate or PEG structure attached to a protein. As used herein, "amino acid modification" means an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

As used herein, "amino acid substitution" or "substitution" means the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

As used herein, "amino acid insertion" or "insertion" means the addition of an amino acid sequence at a particular position in a parent polypeptide sequence. For example, −233E or 233E designates an insertion of glutamic acid after position 233 and before position 234. Additionally, −233ADE or A233ADE designates an insertion of AlaAspGlu after position 233 and before position 234.

As used herein, "amino acid deletion" or "deletion" means the removal of an amino acid sequence at a particular position in a parent polypeptide sequence. For example, E233- or E233 # or E233( ) designates a deletion of glutamic acid at position 233. Additionally, EDA233- or EDA233 #designates a deletion of the sequence GluAspAla that begins at position 233.

The terms "variant protein" or "protein variant", or "variant" as used herein mean a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4, although human sequences with variants can also serve as "parent polypeptides", for example the IgG1/2 hybrid of FIG. 13. The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it. Accordingly, the terms "antibody variant" or "variant antibody" as used herein mean an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein mean an immunoglobulin sequence that differs from that of a parent immunoglobulin sequence by virtue of at least one amino acid modification. "Fc variant" or "variant Fc" as used herein means a protein comprising an amino acid modification in an Fc domain. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference.) The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004-0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" means at least two covalently attached amino acids, which includes proteins, polypeptides, oligopeptides and peptides. The terms "protein" and "stretch of consecutive amino acids" are used interchangeably herein. The peptidyl group may comprise naturally occurring amino acids and peptide bonds, or synthetic peptidomimetic structures, i.e. "analogs", such as peptoids (see Simon et al., PNAS USA 89 (20): 9367 (1992), entirely incorporated by reference). The amino acids may either be naturally occurring or synthetic (e.g. not an amino acid that is coded for by DNA); as will be appreciated by those in the art. For example, homo-phenylalanine, citrulline, ornithine and noreleucine are considered synthetic amino acids for the purposes of the invention, and both D- and L-(R or S) configured amino acids may be utilized. The variants of the present invention may comprise modifications that include the use of synthetic amino acids incorporated using, for example, the technologies developed by Schultz and colleagues, including but not limited to methods described by Cropp & Shultz, 2004, Trends Genet. 20 (12): 625-30, Anderson et al., 2004, Proc Natl Acad Sci USA 101 (2): 7566-71, Zhang et al., 2003, 303 (5656): 371-3, and Chin et al., 2003, Science 301 (5635): 964-7, all entirely incorporated by reference. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

The term "residue" as used herein means a position in a protein and its associated amino acid identity. For example, Asparagine 297 (also referred to as Asn297 or N297) is a residue at position 297 in the human antibody IgG1.

As used herein "Fab" or "Fab region" means the polypeptide that comprises the VH, $CH_1$, VL, and CL immunoglobulin domains. Fab may refer to this region in isolation, or this region in the context of a full length antibody, antibody fragment or Fab fusion protein. "Fv" or "Fv fragment" or "Fv region" as used herein mean a polypeptide that comprises the VL and VH domains of a single antibody.

"IgG subclass modification" or "isotype modification" as used herein mean an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

The term "non-naturally occurring modification" means an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

The term "effector function" as used herein means a biochemical event that results from the interaction of an antibody Fc region with an Fc receptor or ligand. Effector functions include but are not limited to ADCC, ADCP, and CDC.

The term "IgG Fc ligand" as used herein means a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. "Fc ligand" as used herein means a molecule, preferably a polypeptide, from any organism that binds to the Fc region of an antibody to form an Fc/Fc ligand complex.

The terms "Fc gamma receptor", "FcγR", "FcgammaR" or "FcgR" as used herein mean any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

The terms "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life, are shown in the Figure Legend of FIG. 11.

The terms "parent polypeptide" as used herein mean a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, "parent immunoglobulin" as used herein means an unmodified immunoglobulin polypeptide that is modified to generate a variant, and "parent antibody" as used herein means an unmodified antibody that is modified to generate a variant antibody. It should be noted that "parent antibody" includes known commercial, recombinantly produced antibodies as outlined below.

The terms "Fc fusion protein" or "immunoadhesin" as used herein means a protein comprising an Fc region, generally linked (optionally through a linker moiety, as described herein) to a different protein, such as a binding moiety to a target protein, as described herein. In some cases, one monomer of the heterodimeric protein comprises an antibody heavy chain (either including an scFv or further including a light chain) and the other monomer is an Fc fusion, comprising a variant Fc domain and a ligand.

The term "position" as used herein is meant a location in the sequence of a protein. Positions may be numbered sequentially, or according to an established format, for example the EU index for antibody numbering.

The term "target antigen" as used herein means the molecule that is bound specifically by the variable region of a given antibody. A target antigen may be a protein, carbohydrate, lipid, or other chemical compound. A wide number of suitable target antigens are described below.

The term "target cell" as used herein means a cell that expresses a target antigen.

The term "variable region" as used herein means the region of an immunoglobulin that comprises one or more Ig domains substantially encoded by any of the Vκ, Vλ, and/or VH genes that make up the kappa, lambda, and heavy chain immunoglobulin genetic loci respectively.

The term "wild type or wt" as used herein means an amino acid sequence or a nucleotide sequence that is found in nature, including allelic variations. A WT protein has an amino acid sequence or a nucleotide sequence that has not been intentionally modified.

The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about 10-4 M, at least about 10-5 M, at least about 10-6 M, at least about 10-7 M, at least about 10-8 M, at least about 10-9 M, alternatively at least about 10-10 M, at least about 10-11 M, at least about 10-12 M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction.

As used herein "ablation" means a decrease or removal of activity. Thus, for example, "ablating FcγR binding" means the Fc region amino acid variant has less than 50% starting binding as compared to an Fc region not containing the specific variant, with less than 70-80-90-95-98% loss of activity being preferred, and in general, with the activity being below the level of detectable binding in a Carterra assay.

As used herein, "ADCC" or "antibody dependent cell-mediated cytotoxicity" means cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

As used herein "ADCP" or antibody dependent cell-mediated phagocytosis mean the cell-mediated reaction wherein nonspecific cytotoxic cells that express FcγRs recognize bound antibody on a target cell and subsequently cause phagocytosis of the target cell.

In an aspect, the invention provides a stretch of consecutive amino acids (i.e. a protein) having at least about 80% sequence identity, preferably at least about 81% sequence identity, more preferably at least about 82% sequence identity, yet more preferably at least about 83% sequence identity, yet more preferably at least about 84% sequence identity, yet more preferably at least about 85% sequence identity, yet more preferably at least about 86% sequence identity, yet more preferably at least about 87% sequence identity, yet more preferably at least about 88% sequence identity, yet more preferably at least about 89% sequence identity, yet more preferably at least about 90% sequence identity, yet more preferably at least about 91% sequence identity, yet more preferably at least about 92% sequence identity, yet more preferably at least about 93% sequence identity, yet more preferably at least about 94% sequence identity, yet more preferably at least about 95% sequence identity, yet more preferably at least about 96% sequence identity, yet more preferably at least about 97% sequence identity, yet more preferably at least about 98% sequence identity and yet more preferably at least about 99% sequence identity to an amino acid sequence disclosed in the specification, a figure, a SEQ ID NO. or a sequence listing of the present application. Similarly, the invention provides dimers and trimers comprising such proteins, including those described in the Examples of the invention.

The % amino acid sequence identity values can be readily obtained using, for example, the WU-BLAST-2 computer program (Altschul et al., Methods in Enzymology 266:460-480 (1996)).

Fragments of native sequences are provided herein. Such fragments may be truncated at the N-terminus or C-terminus, or may lack internal residues, for example, when compared with a full-length native protein. Again, it is understood that any terminal variations are made within the context of the invention disclosed herein.

Certain fragments lack amino acid residues that are not essential for a desired biological activity of the sequence of interest.

Any of a number of conventional techniques may be used. Desired peptide fragments or fragments of stretches of consecutive amino acids may be chemically synthesized. An alternative approach involves generating fragments by enzymatic digestion, e.g. by treating the protein with an enzyme known to cleave proteins at sites defined by particular amino acid residues, or by digesting the DNA with suitable restriction enzymes and isolating the desired fragment. Yet another suitable technique involves isolating and amplifying a DNA fragment encoding a desired polypeptide/sequence fragment, by polymerase chain reaction (PCR). Oligonucleotides that define the desired termini of the DNA fragment are employed at the 5' and 3' primers in the PCR.

In particular embodiments, conservative substitutions of interest are shown in Table A under the heading of preferred substitutions. If such substitutions result in a change in biological activity, then more substantial changes, denominated exemplary substitutions in Table A, or as further described below in reference to amino acid classes, are introduced and the products screened.

TABLE A

| Conservative amino acid substitutions | | |
|---|---|---|
| Original | Exemplary | Preferred |
| Ala (A) | val; leu; ile | val |
| Arg (R) | lys; gln; asn | lys |
| Asn (N) | gln; his; lys; arg | gln |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

Substantial modifications in function or immunological identity of the sequence are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:

a) hydrophobic: norleucine, met, ala, val, leu, ile;

b) neutral hydrophilic: cys, ser, thr;

c) acidic: asp, glu;

d) basic: asn, gln, his, lys, arg;

e) residues that influence chain orientation: gly, pro;

f) aromatic: trp, tyr, phe.

Non-conservative substitutions will entail exchanging a member of one of these classes for another class. Such substituted residues also may be introduced into the conservative substitution sites or, more preferably, into the remaining (non-conserved) sites.

The variations can be made using methods known in the art such as oligonucleotide-mediated (site-directed) mutagenesis, alanine scanning, and PCR mutagenesis. Site-directed mutagenesis (Carter et al., Nucl. Acids Res., 13:4331 (1986); Zoller et al., Nucl. Acids Res., 10:6487 (1987)), cassette mutagenesis (Wells et al., Gene, 34:315 (1985)), restriction selection mutagenesis (Wells et al., Philos. Trans. R. Soc. London SerA, 317:415 (1986)) or other known techniques can be performed on the cloned DNA to produce the variant DNA.

Scanning amino acid analysis can also be employed to identify one or more amino acids along a contiguous sequence. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant (Cunningham and Wells, Science, 244:1081-1085 (1989)). Alanine is also typically preferred because it is the most common amino acid. Further, it is frequently found in both buried and exposed positions (Creighton, The Proteins, (W.H. Freeman & Co., N.Y.); Chothia, J. Mol. Biol., 150:1 (1976)). If alanine substitution does not yield adequate amounts of variant, an isoteric amino acid can be used.

Covalent modifications: The stretch of consecutive amino acids may be covalently modified. One type of covalent modification includes reacting targeted amino acid residues with an organic derivatizing agent that is capable of reacting with selected side chains or the N- or C-terminal residues that are not involved in an -x-x- bond. Derivatization with bifunctional agents is useful, for instance, for crosslinking to a water-insoluble support matrix or surface for use in the method for purifying anti-sequence of interest antibodies, and vice-versa. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-((p-azidophenyl)dithio) propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the .alpha.-amino groups of lysine, arginine, and histidine side chains (T. E. Creighton, Proteins: Structure and Molecular Properties, W.H. Freeman & Co., San Francisco, pp. 79-86 (1983)), acetylation of the N-terminal amine, and amidation of any C-terminal carboxyl group.

Another type of covalent modification comprises altering the native glycosylation pattern of the stretch of consecutive amino acids. "Altering the native glycosylation pattern" is intended for purposes herein to mean deleting one or more carbohydrate moieties found in amino acid sequences (either by removing the underlying glycosylation site or by deleting the glycosylation by chemical and/or enzymatic means), and/or adding one or more glycosylation sites that are not present in the native sequence. In addition, the phrase includes qualitative changes in the glycosylation of the native proteins, involving a change in the nature and proportions of the various carbohydrate moieties present.

Addition of glycosylation sites to the amino acid sequence may be accomplished by altering the amino acid sequence. The alteration may be made, for example, by the addition of, or substitution by, one or more serine or threonine residues to the native sequence (for O-linked glycosylation sites). The amino acid sequence may optionally be altered through changes at the DNA level, particularly by mutating the DNA encoding the amino acid sequence at preselected bases such that codons are generated that will translate into the desired amino acids.

Another means of increasing the number of carbohydrate moieties on the amino acid sequence is by chemical or enzymatic coupling of glycosides to the polypeptide. Such methods are described in the art, e.g., in WO 87/05330 published Sep. 11, 1987, and in Aplin and Wriston, CRC Crit. Rev. Biochem., pp. 259-306 (1981).

Removal of carbohydrate moieties present on the amino acid sequence may be accomplished chemically or enzymatically or by mutational substitution of codons encoding for amino acid residues that serve as targets for glycosylation. Chemical deglycosylation techniques are known in the art and described, for instance, by Hakimuddin, et al., Arch. Biochem. Biophys., 259:52 (1987) and by Edge et al., Anal. Biochem., 118:131 (1981). Enzymatic cleavage of carbohydrate moieties on polypeptides can be achieved by the use of a variety of endo- and exo-glycosidases as described by Thotakura et al., Meth. Enzymol., 138:350 (1987).

Another type of covalent modification comprises linking the amino acid sequence to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The term “substitution”, “substituted” and “substituent” refers to a functional group in which one or more bonds to a hydrogen atom contained therein are replaced by a bond to non-hydrogen atoms, provided that normal valencies are maintained and that the substitution results in a stable compound. Substituted groups also include groups in which one or more bonds to a carbon(s) or hydrogen(s) atom are replaced by one or more bonds, including double or triple bonds, to a heteroatom. Examples of substituent groups include halogens (i.e., F, Cl, Br, and I); alkyl groups, such as methyl, ethyl, n-propyl, isopropyl, n-butyl, tert-butyl, and trifluoromethyl; aryl groups, such as phenyl; heteroaryl groups, such as triazole, dihydropyridazine and tetrazole; hydroxyl; alkoxy groups, such as methoxy, ethoxy, n-propoxy, and isopropoxy; aryloxy groups, such as phenoxy; arylalkyloxy, such as benzyloxy (phenylmethoxy) and p-trifluoromethylbenzyloxy (4-trifluoromethylphenylmethoxy); heteroaryloxy groups; sulfonyl groups, such as sulfonate, trifluoromethanesulfonyl, methanesulfonyl, and p-toluenesulfonyl; sulfnitro, nitrosyl; mercapto; sulfanyl groups, such as methylsulfanyl, ethylsulfanyl and propylsulfanyl; cyano; amino groups, such as amino, methylamino, dimethylamino, ethylamino, and diethylamino; and carboxyl. Where multiple substituent moieties are disclosed or claimed, the substituted compound can be independently substituted by one or more of the disclosed or claimed substituent moieties, singly or plurally. By independently substituted, it is meant that the (two or more) substituents can be the same or different. In the compounds used in the method of the present invention, alkyl, heteroalkyl, monocycle, bicycle, aryl, heteroaryl and heterocycle groups can be substituted by replacing one or more hydrogen atoms with alternative non-hydrogen groups. These include, but are not limited to, halo, hydroxy, mercapto, amino, carboxy, cyano and carbamoyl.

It is understood that substituents and substitution patterns on the compounds used in the method of the present invention can be selected by one of ordinary skill in the art to provide compounds that are chemically stable and that can be readily synthesized by techniques known in the art from readily available starting materials. If a substituent is itself substituted with more than one group, it is understood that these multiple groups may be on the same carbon or on different carbons, so long as a stable structure results.

In choosing the compounds used in the method of the present invention, one of ordinary skill in the art will recognize that the various substituents, i.e. R1, R2, etc. are to be chosen in conformity with well-known principles of chemical structure connectivity.

As used herein, “alkyl” includes both branched and straight-chain saturated aliphatic hydrocarbon groups having the specified number of carbon atoms and may be unsubstituted or substituted. Thus, $C_1$-$C_n$ as in “$C_1$-$C_n$ alkyl” is defined to include groups having 1, 2, . . . , n−1 or n carbons in a linear or branched arrangement. For example, $C_1$-$C_6$, as in “$C_1$-$C_6$ alkyl” is defined to include groups having 1, 2, 3, 4, 5, or 6 carbons in a linear or branched arrangement, and specifically includes methyl, ethyl, n-propyl, isopropyl, n-butyl, t-butyl, pentyl, and hexyl. Unless otherwise specified contains one to twelve carbons. Alkyl groups can be unsubstituted or substituted with one or more substituents, including but not limited to halogen, alkoxy, alkylthio, trifluoromethyl, difluoromethyl, methoxy, and hydroxyl. An embodiment can be $C_1$-$C_{12}$ alkyl, $C_2$-$C_{12}$ alkyl, $C_3$-$C_{12}$ alkyl, $C_4$-$C_{12}$ alkyl and so on. An embodiment can be $C_1$-$C_8$ alkyl, $C_2$-$C_8$ alkyl, $C_3$-$C_8$ alkyl, $C_4$-$C_8$ alkyl and so on. Alkyl is intended to include moieties that are monovalent, divalent, trivalent, etc.

As used herein, “$C_1$-$C_4$ alkyl” includes both branched and straight-chain $C_1$-$C_4$ alkyl.

As used herein, the term “cycloalkane” refers to a monocyclic or bicyclic ring system, which may be unsaturated or partially unsaturated, i.e. possesses one or more double bonds. Monocyclic ring systems are exemplified by a saturated cyclic hydrocarbon group containing from 3 to 8 carbon atoms. Examples of monocyclic ring systems include cyclopropyl, cyclobutyl, cyclopentyl, cyclopentenyl, cyclohexyl, cyclohexenyl, cycloheptyl and cyclooctyl. Bicyclic fused ring systems are exemplified by a cycloalkyl ring fused to another cycloalkyl ring. Examples of bicyclic fused ring systems include, but are not limited to, decalin, 1,2,3,7,8,8a-hexahydro-naphthalene, and the like. Thus, $C_3$-$C_{10}$ cycloalkane includes cyclic rings of alkanes of three to eight total carbon atoms, (e.g., cyclopropyl, cyclobutyl, cyclopentyl, cyclohexyl, cycloheptyl or cyclooctyl and so on). Cycloalkane groups can be unsubstituted or substituted with one or more substituents, including but not limited to halogen, alkoxy, alkylthio, trifluoromethyl, difluoromethyl, methoxy, and hydroxyl. Cycloalkane is intended to include moieties that are monovalent, divalent, trivalent, etc.

As used herein, the term “cycloalkene” refers to a cycloalkane which possesses one or more double bonds. Thus, $C_5$-$C_{10}$ cycloalkene includes cyclic rings of alkanes of five to ten total carbon atoms, (e.g., cyclopentenyl, cyclohexenyl, cycloheptenyl, cyclohexadienyl, cyclooctenyl or cyclooctadienyl and so on). Cycloalkene is intended to moieties that are monovalent, divalent, trivalent, etc. Cycloalkene is intended to include moieties that are monovalent, divalent, trivalent, etc.

As used herein, “alkene” includes both branched and straight-chain aliphatic hydrocarbon groups having one or more double bond and the specified number of carbon atoms and may be unsubstituted or substituted. Thus, $C_2$-$C_n$ as in “$C_2$-$C_n$ alkene” is defined to include groups having 2, 3, . . . , n−1 or n carbons in a linear or branched arrangement. For example, $C_2$-$C_{10}$, as in “$C_2$-$C_{10}$ alkene” is defined to include groups having 2, 3, 4, 5 . . . 10 carbons in a linear or branched arrangement, and specifically includes vinyl, allyl, 1-butene, 2-butene, iso-butene, 1-pentene, 2-pentene, etc. Alkyene groups can be unsubstituted or substituted with one or more substituents, including but not limited to halogen, alkoxy, alkylthio, trifluoromethyl, difluoromethyl, methoxy, and hydroxyl. An embodiment can be $C_2$-$C_3$ alkene, $C_2$-$C_4$ alkene, $C_2$-$C_5$ alkene, and so on. Alkene is intended to include moieties that are monovalent, divalent, trivalent, etc.

As used herein, an "acyl" refers to an alkyl group having a ketone at the first position. For example, an "acyl" embodiment can be acetyl, propionyl, butyryl and valeryl. As another example, an "acyl" embodiment can be:

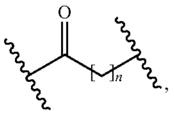

wherein n is 1-10. In another embodiment, n is 1-4.

Thus, a "$C_2$-$C_5$ acyl" can be acetyl, propionyl, butyryl, or and valeryl. Acyl is intended to include moieties that are monovalent, divalent, trivalent, etc.

$C_2$-$C_5$ acylamino is an acyl group as defined above further substituted with an amine. The amine may be linked to the carbonyl portion of the acyl group so as to form an amide or the amine may linked to a non-carbonyl portion of the acyl group. For example, the amino group may be at the alpha-position, the beta-position, the gamma-position, the delta-position, etc. As further examples, acylamino includes both alpha-aminoacetyl and acetamido groups. Acylamino includes beta-aminopropionyl).

$C_2$-$C_5$ acyloxy is an acyl group as defined above further substituted with an oxygen. The oxygen may be linked to the carbonyl portion of the acyl group so as to form an amide or the oxygen may linked to a non-carbonyl portion of the acyl group. For example, the oxygen group may be at the alpha-position, the beta-position, the gamma-position, the delta-position, etc. As further examples, acyloxy includes both alpha-oxyacetyl and acetate groups. Acyloxy includes beta-oxypropionyl).

As used herein, "amino" includes primary, secondary, tertiary and quaternary amines. Thus, amino includes a —NH— group, a $—NH_2$ group, a —NR— group, a $—NR_2^+—$ group, a $—NRH^+—$ group, a $—NH_2^+—$ group, a $—NH_3^+$ group and a $—NR_3^+$ group, wherein R is alkyl or aryl. Amino is intended to include moieties that are monovalent, divalent, trivalent, etc.

As used herein, "sulfur" includes a —S— group and a —SH group. The term sulfur is intended to include moieties that are monovalent, divalent, trivalent, etc.

As used herein, "oxygen" includes a —O— group and a —OH group. The term sulfur is intended to moieties that are monovalent and divalent.

As used herein, "succinyl" is derived from succinic acid by removal of one or both hydroxyl groups. An embodiment can be $—C(O)—CH_2—CH_2—C(O)—$. Succinyl is intended to include moieties that are monovalent, divalent, trivalent, etc.

As used herein, a "malonyl" is derived from malonic acid by removal of one or both hydroxyl groups. An embodiment can be $—C(O)—CH_2—C(O)—$. Malonyl is intended to include moieties that are monovalent, divalent, trivalent, etc.

As used herein, a "glutaryl" is derived from glutaric acid by removal of one or both hydroxyl groups. An embodiment can be $—C(O)—CH_2—CH_2—CH_2—C(O)—$. Glutaryl is intended to include moieties that are monovalent, divalent, trivalent, etc.

As used herein, an "adipoyl" is derived from adipic acid by removal of one or both hydroxyl groups. An embodiment can be $—C(O)—CH_2—CH_2—CH_2—CH_2—(O)—$. Adipoyl is intended to include moieties that are monovalent, divalent, trivalent, etc.

A "polyalkylene glycol" is derived from polyalkylene glycol by removal of both hydrogens from the hydroxyl groups. An embodiment can be derived from polyethylene glycol, polypropylene glycol, or polybutylene glycol.

An "polyalkylene glycol" embodiment can be

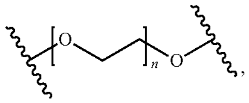

,

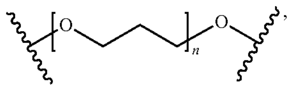

, or

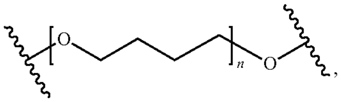

, wherein n is 1-10.

As used herein, "aryl" is intended to mean any stable monocyclic, bicyclic or polycyclic carbon ring of up to 10 atoms in each ring, wherein at least one ring is aromatic, and may be unsubstituted or substituted. Examples of such aryl elements include but are not limited to: phenyl, p-toluenyl (4-methylphenyl), naphthyl, tetrahydro-naphthyl, indanyl, phenanthryl, anthryl or acenaphthyl. In cases where the aryl substituent is bicyclic and one ring is non-aromatic, it is understood that attachment is via the aromatic ring.

The term "heteroaryl", as used herein, represents a stable monocyclic, bicyclic or polycyclic ring of up to 10 atoms in each ring, wherein at least one ring is aromatic and contains from 1 to 4 heteroatoms selected from the group consisting of O, N and S. Bicyclic aromatic heteroaryl groups include phenyl, pyridine, pyrimidine or pyridizine rings that are (a) fused to a 6-membered aromatic (unsaturated) heterocyclic ring having one nitrogen atom; (b) fused to a 5- or 6-membered aromatic (unsaturated) heterocyclic ring having two nitrogen atoms; (c) fused to a 5-membered aromatic (unsaturated) heterocyclic ring having one nitrogen atom together with either one oxygen or one sulfur atom; or (d) fused to a 5-membered aromatic (unsaturated) heterocyclic ring having one heteroatom selected from O, N or S. Heteroaryl groups within the scope of this definition include but are not limited to: benzoimidazolyl, benzofuranyl, benzofurazanyl, benzopyrazolyl, benzotriazolyl, benzothiophenyl, benzoxazolyl, carbazolyl, carbolinyl, cinnolinyl, dihydropyridizine, furanyl, indolinyl, indolyl, indolazinyl, indazolyl, isobenzofuranyl, isoindolyl, isoquinolyl, isothiazolyl, isoxazolyl, naphthpyridinyl, oxadiazolyl, oxazolyl, oxazoline, isoxazoline, oxetanyl, pyranyl, pyrazinyl, pyrazolyl, pyridazinyl, pyridopyridinyl, pyridazinyl, pyridyl, pyrimidyl, pyrrolyl, quinazolinyl, quinolyl, quinoxalinyl, tetrazolyl, tetrazolopyridyl, thiadiazolyl, thiazolyl, thienyl, triazolyl, azetidinyl, aziridinyl, 1,4-dioxanyl, hexahydroazepinyl, dihydrobenzoimidazolyl, dihydrobenzofuranyl, dihydrobenzothiophenyl, dihydrobenzoxazolyl, dihydrofuranyl, dihydroimidazolyl, dihydroindolyl, dihydroisooxazolyl, dihydroisothiazolyl, dihydrooxadiazolyl, dihydrooxazolyl, dihydropyrazinyl, dihydropyrazolyl, dihydropyridinyl, dihydropyrimidinyl, dihydropyrrolyl, dihydroquinolinyl, dihydrotetrazolyl, dihydrothiadiazolyl, dihydrothiazolyl, dihydrothienyl, dihydrotriazolyl, dihydroazetidinyl, methylenedioxybenzoyl, tetrahydrofuranyl, tetrahydrothienyl, acridinyl, carbazolyl, cinnolinyl, quinoxalinyl, pyrrazolyl, indolyl, benzotriazolyl, benzothiazolyl, benzoxazolyl, isoxazolyl, isothiazolyl, furanyl, thienyl, benzothienyl, benzofuranyl, quinolinyl, isoquinolinyl, oxazolyl, isoxazolyl, indolyl, pyrazinyl, pyridazinyl, pyridinyl, pyrimidinyl, pyrrolyl, tetra-hydroquinoline. In cases where the heteroaryl substituent is bicyclic and one ring is non-aromatic or contains no heteroatoms, it is understood that attachment is via the aromatic ring or via the heteroatom containing ring, respectively. If the heteroaryl contains nitrogen atoms, it is understood that the corresponding N-oxides thereof are also encompassed by this definition.

The term "phenyl" is intended to mean an aromatic six membered ring containing six carbons, and any substituted derivative thereof.

The term "benzyl" is intended to mean a methylene attached directly to a benzene ring. A benzyl group is a methyl group wherein a hydrogen is replaced with a phenyl group, and any substituted derivative thereof.

The term "triazole" is intended to mean a heterary having a five-membered ring containing two carbon atoms and three nitrogen atoms, and any substituted derivative thereof.

Dihydropyradizine is optionally substituted and includes 1,2-dihydropyridazines,

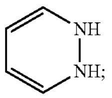

1,4-dihydropyridazines,

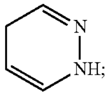

1,6-dihydropyridazines,

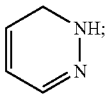

and 4,5-dihydropyridazines,

A chemical structure containing a cyclooctane fused to a dihydropyridazine includes, but is not limited to, a chemical structure which contains a cyclooctane fused to the 3rd and 4th position of a dihydropyridazine or a chemical structure which contains a saturated cycloocta[d]pyridazine, any of which are optionally substituted. For example, the chemical structure containing a cyclooctane fused to a dihydropyridazine includes, but is not limited to, a chemical structure which contains a 2,4a,5,6,7,8,9,10-octahydrocycloocta[d]pyridazine,

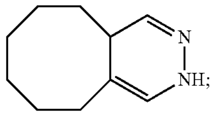 [SMILES: C1=NNC=C2CCCCCCC12]

a 4a,5,6,7,8,9,10,10a-octahydrocycloocta[d]pyridazine,

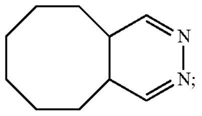 [SMILES: C1=NN=CC2CCCCCCC12]

a 2,3,5,6,7,8,9,10-octahydrocycloocta[d]pyridazine,

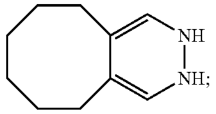 [SMILES: C1=C2CCCCCCC2=CNN1]

or a 1,2,5,6,7,8,9,10-octahydrocycloocta[d]pyridazine,

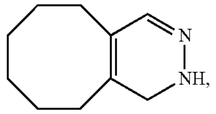 [SMILES: C1=NNCC2=C1CCCCCC2]

each of which may be optionally substituted.

Tautomers of

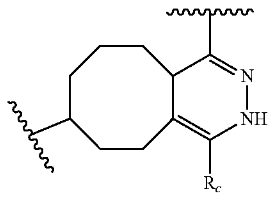

include, but are not limited to:

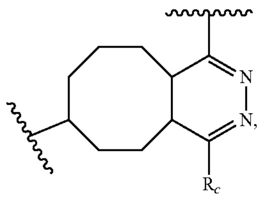

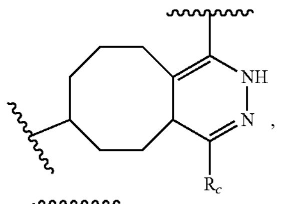

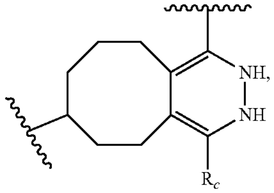

-continued

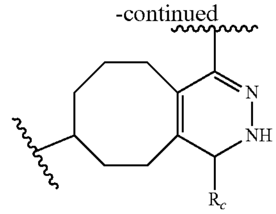

and

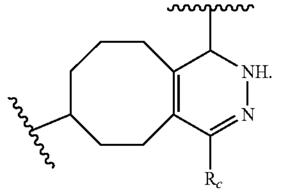

In some embodiments, the dihydropyridazine is oxidized to a pyridazine.

In some embodiments, the dihydropyridazine is reduced to result in an open ring structure having a 1,4-dicarbonyl compound.

The compounds used in the method of the present invention may be prepared by techniques well know in organic synthesis and familiar to a practitioner ordinarily skilled in the art. However, these may not be the only means by which to synthesize or obtain the desired compounds.

Compounds of the subject invention can be converted to prodrugs to optimize absorption and bioavailability. Formation of a prodrug include, but is not limited to, reaction of a free hydroxyl group with a carboxylic acid to form an ester, reaction of a free hydroxyl group with an phosphorus oxychloride followed by hydrolysis to form a phosphate, or reaction of a free hydroxyl group with an amino acid to form an amino acid ester, the process of which has been described previously by Chandran in WO 2005/046575. The substituents are chosen and resulting analogs are evaluated according to principles well known in the art of medicinal and pharmaceutical chemistry, such as quantification of structure-activity relationships, optimization of biological activity and ADMET (absorption, distribution, metabolism, excretion, and toxicity) properties.

The various R groups attached to the aromatic rings of the compounds disclosed herein may be added to the rings by standard procedures, for example those set forth in Advanced Organic Chemistry: Part B: Reaction and Synthesis, Francis Carey and Richard Sundberg, (Springer) 5th ed. Edition. (2007), the content of which is hereby incorporated by reference.

The compounds of present invention may be prepared by techniques described in Vogel's Textbook of Practical Organic Chemistry, A. I. Vogel, A. R. Tatchell, B. S. Furnis, A. J. Hannaford, P. W. G. Smith, (Prentice Hall) 5th Edition (1996), March's Advanced Organic Chemistry: Reactions, Mechanisms, and Structure, Michael B. Smith, Jerry March, (Wiley-Interscience) 5th Edition (2007), and references therein, which are incorporated by reference herein. However, these may not be the only means by which to synthesize or obtain the desired compounds.

A person having ordinary skill in the art will immediately understand that the definitions of the substituents and moieties provided herein are intended to obey the standard rules of chemical valency. For example, where a structure provided herein requires a particular substituent or moiety to be divalent, (e.g. a moiety in a linear chain of moieties) a person having ordinary skill in the art will immediately understand that the definitions of that substituent or moiety are divalent in order to obey the standard rules of chemical valency.

A person having ordinary skill in the art will immediately understand that some divalent moieties depicted in the present invention may be linked to other chemical structures in more than one way, e.g., the depicted structures may be linked to other chemical structures when rotated or flipped.

In some embodiments of the present invention, a compound comprises a nonproteinaceous polymer. In some embodiments, the nonproteinaceous polymer may be is a hydrophilic synthetic polymer, i.e., a polymer not otherwise found in nature. However, polymers which exist in nature and are produced by recombinant or in vitro methods are useful, as are polymers which are isolated from nature. Hydrophilic polyvinyl polymers fall within the scope of this invention, e.g. polyvinylalcohol and polyvinylpyrrolidone. Particularly useful are polyalkylene ethers such as polyethylene glycol, polypropylene glycol, polyoxyethylene esters or methoxy polyethylene glycol; polyoxyalkylenes such as polyoxyethylene, polyoxypropylene, and block copolymers of polyoxyethylene and polyoxypropylene (Pluronics); polymethacrylates; carbomers; branched or unbranched polysaccharides which comprise the saccharide monomers D-mannose, D- and L-galactose, fucose, fructose, D-xylose, L-arabinose, D-glucuronic acid, sialic acid, D-galacturontc acid, D-mannuronic acid (e.g. polymannuronic acid, or alginic acid), D-glucosamine, D-galactosamine, D-glucose and neuraminic acid including homopolysaccharides and heteropolysaccharides such as lactose, amylopectin, starch, hydroxyethyl starch, amylose, dextran sulfate, dextran, dextrins, glycogen, or the polysaccharide subunit of acid mucopolysaccharides, e.g. hyaluronic acid; polymers of sugar alcohols such as polysorbitol and polymannitol; and heparin or heparon.

Salts

Salts of the compounds disclosed herein are within the scope of the invention. As used herein, a "salt" is salt of the instant compounds which has been modified by making acid or base salts of the compounds.

Stretches of Consecutive Amino Acids/Domains

Domains of the invention may be any of the stretches of consecutive amino acids as referred to herein. Examples of stretches of consecutive amino acids as referred to herein include, but are not limited to, consecutive amino acids including binding domains of proteins such as secreted or transmembrane proteins, intracellular binding domains and antibodies (whole or portions thereof) and modified versions thereof. Thus, domains of the invention include, without limitation, binding domains of proteins or portions or modified versions thereof, secreted proteins or portions or modified versions thereof, transmembrane proteins or portions or modified versions thereof, intracellular binding domains or portions or modified versions thereof, and antibodies or portions or modified versions thereof. In the case of portions of transmembrane proteins, this invention specifically contemplates transmembrane domains of transmembrane proteins, in particular heterologous transmembrane domains. The following are some non-limiting examples:

Immunoglobulins

The term "antibody" is used in the broadest sense and specifically covers monoclonal antibodies (including full length monoclonal antibodies), polyclonal antibodies, multispecific antibodies (e.g., bispecific antibodies), monovalent antibodies, multivalent antibodies, and antibody fragments so long as they exhibit the desired biological activity (e.g., Fab and/or single-armed antibodies).

The "class" of an antibody refers to the type of constant domain or constant region possessed by its heavy chain. There are five major classes of antibodies: IgA, IgD, IgE, IgG, and IgM, and several of these may be further divided into subclasses (isotypes), e.g., IgG1, IgG2, IgG3, IgG4, IgA1, and IgA2. The heavy chain constant domains that correspond to the different classes of immunoglobulins are called a, 8, &, Y, and u, respectively.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')2; diabodies; linear antibodies; single-chain antibody molecules (e.g., scFv); and multispecific antibodies formed from antibody fragments.

The terms "full length antibody," "intact antibody," and "whole antibody" are used herein interchangeably to refer to an antibody having a structure substantially similar to a native antibody structure or having heavy chains that contain an Fc region as defined herein.

A "blocking" antibody or an "antagonist" antibody is one which significantly inhibits (either partially or completely) a biological activity of the antigen it binds.

An "antibody that binds to the same epitope" as a reference antibody refers to an antibody that blocks binding of the reference antibody to its antigen in a competition assay by 50% or more, and conversely, the reference antibody blocks binding of the antibody to its antigen in a competition assay by 50% or more. An exemplary competition assay is provided herein.

The term "variable region" or "variable domain" refers to the domain of an antibody heavy or light chain that is involved in binding the antibody to antigen. The variable domains of the heavy chain and light chain (VH and VL, respectively) of a native antibody generally have similar structures, with each domain comprising four conserved framework regions (FRs) and three hypervariable regions (HVRs). (See, e.g., Kindt et al. Kuby Immunology, 6th ed., W.H. Freeman and Co., page 91 (2007).) A single VH or VL domain may be sufficient to confer antigen-binding specificity. Furthermore, antibodies that bind a particular antigen may be isolated using a VH or VL domain from an antibody that binds the antigen to screen a library of complementary VL or VH domains, respectively. See, e.g., Portolano et al., J. Immunol. 150:880-887 (1993); Clarkson et al., Nature 352:624-628 (1991).

The term "hypervariable region" or "HVR," as used herein, refers to each of the regions of an antibody variable domain which are hypervariable in sequence and/or form structurally defined loops ("hypervariable loops"). Generally, native four-chain antibodies comprise six HVRs; three in the VH (H1, H2, H3), and three in the VL (L1, L2, L3). HVRs generally comprise amino acid residues from the hypervariable loops and/or from the "complementarity determining regions" (CDRs), the latter being of highest sequence variability and/or involved in antigen recognition. Exemplary hypervariable loops occur at amino acid residues 26-32 (L1), 50-52 (L2), 91-96 (L3), 26-32 (H1), 53-55 (H2), and 96-101 (H3). (Chothia and Lesk, J. Mol. Biol. 196:901-917 (1987).) Exemplary CDRs (CDR-L1, CDR-L2, CDR-L3, CDR-H1, CDR-H2, and CDR-H3) occur at amino acid residues 24-34 of L1, 50-56 of L2, 89-97 of L3, 31-35B of H1, 50-65 of H2, and 95-102 of H3. (Kabat et al., Sequences of Proteins of Immunological Interest, 5th Ed. Public Health Service, National Institutes of Health, Bethesda, Md. (1991) .) With the exception of CDR1 in VH, CDRs generally comprise the amino acid residues that form the hypervariable loops. CDRs also comprise "specificity determining residues," or "SDRs," which are residues that contact antigen. SDRs are contained within regions of the CDRs called abbreviated-CDRs, or a-CDRs. Exemplary a-CDRs (a-CDR-L1, a-CDR-L2, a-CDR-L3, a-CDR-H1, a-CDR-H2, and a-CDR-H3) occur at amino acid residues 31-34 of L1, 50-55 of L2, 89-96 of L3, 31-35B of H1, 50-58 of H2, and 95-102 of H3. (See Almagro and Fransson, Front. Biosci. 13:1619-1633 (2008).) Unless otherwise indicated, HVR residues and other residues in the variable domain (e.g., FR residues) are numbered herein according to Kabat et al., supra.

"Framework" or "FR" refers to variable domain residues other than hypervariable region (HVR) residues. The FR of a variable domain generally consists of four FR domains: FR1, FR2, FR3, and FR4. Accordingly, the HVR and FR sequences generally appear in the following sequence in VH (or VL): FR1-H1 (L1)-FR2-H2 (L2)-FR3-H3 (L3)-FR4.

The phrase "N-terminally truncated heavy chain", as used herein, refers to a polypeptide comprising parts but not all of a full length immunoglobulin heavy chain, wherein the missing parts are those normally located on the N terminal region of the heavy chain. Missing parts may include, but are not limited to, the variable domain, CH1, and part or all of a hinge sequence. Generally, if the wild type hinge sequence is not present, the remaining constant domain(s) in the N-terminally truncated heavy chain would comprise a component that is capable of linkage to another Fc sequence (i.e., the "first" Fc polypeptide as described herein). For example, said component can be a modified residue or an added cysteine residue capable of forming a disulfide linkage.

"Fc receptor" or "FcR" describes a receptor that binds to the Fc region of an antibody. In some embodiments, an FcR is a native human FcR. In some embodiments, an FcR is one which binds an IgG antibody (a gamma receptor) and includes receptors of the FcγRI, FcγRII, and FcγRIII subclasses, including allelic variants and alternatively spliced forms of those receptors. FcγRII receptors include FcγRIIA (an "activating receptor") and FcγRIIB (an "inhibiting receptor"), which have similar amino acid sequences that differ primarily in the cytoplasmic domains thereof. Activating receptor FcγRIIA contains an immunoreceptor tyrosine-based activation motif (ITAM) in its cytoplasmic domain Inhibiting receptor FcγRIIB contains an immunoreceptor tyrosine-based inhibition motif (ITIM) in its cytoplasmic domain. (see, e.g., Daeron, Annu. Rev. Immunol. 15:203-234 (1997)). FcRs are reviewed, for example, in Ravetch and Kinet, Annu. Rev. Immunol 9:457-92 (1991); Capel et al., Immunomethods 4:25-34 (1994); and de Haas et al., J. Lab. Clin. Med. 126:330-41 (1995). Other FcRs, including those to be identified in the future, are encompassed by the term "FcR" herein.

The term "Fc receptor" or "FcR" also includes the neonatal receptor, FcRn, which is responsible for the transfer of maternal IgGs to the fetus (Guyer et al., J. Immunol. 117:587 (1976) and Kim et al., J. Immunol. 24:249 (1994)) and regulation of homeostasis of immunoglobulins. Methods of measuring binding to FcRn are known (see, e.g., Ghetie and Ward., Immunol. Today 18 (12): 592-598 (1997); Ghetie et al., Nature Biotechnology, 15 (7): 637-640 (1997); Hinton et al., J. Biol. Chem. 279 (8): 6213-6216 (2004); WO 2004/92219 (Hinton et al.).

Binding to human FcRn in vivo and serum half life of human FcRn high affinity binding polypeptides can be assayed, e.g., in transgenic mice or transfected human cell lines expressing human FcRn, or in primates to which the polypeptides with a variant Fc region are administered. WO 2000/42072 (Presta) describes antibody variants with improved or diminished binding to FcRs. See also, e.g., Shields et al. J. Biol. Chem. 9 (2): 6591-6604 (2001).

The "hinge region," "hinge sequence", and variations thereof, as used herein, includes the meaning known in the art, which is illustrated in, for example, Janeway et al., Immuno Biology: the immune system in health and disease, (Elsevier Science Ltd., NY) (4th ed., 1999); Bloom et al., Protein Science (1997), 6:407-415; Humphreys et al., J. Immunol. Methods (1997), 209:193-202.

Unless indicated otherwise, the expression "multivalent antibody" is used throughout this specification to denote an antibody comprising three or more antigen binding sites. The multivalent antibody is preferably engineered to have the three or more antigen binding sites and is generally not a native sequence IgM or IgA antibody.

An "Fv" fragment is an antibody fragment which contains a complete antigen recognition and binding site. This region consists of a dimer of one heavy and one light chain variable domain in tight association, which can be covalent in nature, for example in scFv. It is in this configuration that the three HVRs of each variable domain interact to define an antigen binding site on the surface of the VH-VL dimer. Collectively, the six HVRs or a subset thereof confer antigen binding specificity to the antibody. However, even a single variable domain (or half of an Fv comprising only three HVRs specific for an antigen) has the ability to recognize and bind antigen, although usually at a lower affinity than the entire binding site.

The "Fab" fragment contains a variable and constant domain of the light chain and a variable domain and the first constant domain (CH1) of the heavy chain. F(ab')2 antibody fragments comprise a pair of Fab fragments which are generally covalently linked near their carboxy termini by hinge cysteines between them. Other chemical couplings of antibody fragments are also known in the art.

The phrase "antigen binding arm", as used herein, refers to a component part of an antibody fragment that has an ability to specifically bind a target molecule of interest. Generally and preferably, the antigen binding arm is a complex of immunoglobulin polypeptide sequences, e.g., HVR and/or variable domain sequences of an immunoglobulin light and heavy chain.

"Single-chain Fv" or "scFv" antibody fragments comprise the VH and VL domains of antibody, wherein these domains are present in a single polypeptide chain. Generally the Fv polypeptide further comprises a polypeptide linker between the VH and VL domains, which enables the scFv to form the desired structure for antigen binding. For a review of scFv, see Pluckthun in The Pharmacology of Monoclonal Antibodies, Vol 113, Rosenburg and Moore eds. Springer-Verlag, New York, pp. 269-315 (1994).

The term "diabodies" refers to small antibody fragments with two antigen-binding sites, which fragments comprise a heavy chain variable domain (VH) connected to a light chain variable domain (VL) in the same polypeptide chain (VH and VL). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., Proc. Natl. Acad. Sci. USA, 90:6444-6448 (1993).

The expression "linear antibodies" refers to the antibodies described in Zapata et al., Protein Eng., 8 (10): 1057-1062 (1995). Briefly, these antibodies comprise a pair of tandem Fd segments ($V_H$-$C_{H1}$-$V_H$-$C_{H1}$) which, together with complementary light chain polypeptides, form a pair of antigen binding regions. Linear antibodies can be bispecific or monospecific.

The term "monoclonal antibody" as used herein refers to an antibody obtained from a population of substantially homogeneous antibodies, i.e., the individual antibodies comprising the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method. For example, the monoclonal antibodies to be used may be made by a variety of techniques, including but not limited to the hybridoma method, recombinant DNA methods, phage-display methods, and methods utilizing transgenic animals containing all or part of the human immunoglobulin loci, such methods and other exemplary methods for making monoclonal antibodies being described herein.

The term "chimeric" antibody refers to an antibody in which a portion of the heavy and/or light chain is derived from a particular source or species, while the remainder of the heavy and/or light chain is derived from a different source or species.

A "humanized" antibody refers to a chimeric antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization.

A "human antibody" is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

A "naked antibody" refers to an antibody that is not conjugated to a heterologous moiety (e.g., a cytotoxic moiety) or radiolabel. The naked antibody may be present in a pharmaceutical formulation.

"Native antibodies" refer to naturally occurring immunoglobulin molecules with varying structures. For example, native IgG antibodies are heterotetrameric glycoproteins of about 150,000 Daltons, composed of two identical light chains and two identical heavy chains that are disulfide-bonded. From N- to C-terminus, each heavy chain has a variable region (VH), also called a variable heavy domain or a heavy chain variable domain, followed by three constant domains (CH1, CH2, and CH3). Similarly, from N- to C-terminus, each light chain has a variable region (VL), also called a variable light domain or a light chain variable domain, followed by a constant light (CL) domain. The light chain of an antibody may be assigned to one of two types, called kappa (κ) and lambda (λ), based on the amino acid sequence of its constant domain.

"Affinity" refers to the strength of the sum total of noncovalent interactions between a single binding site of a molecule (e.g., an antibody) and its binding partner (e.g., an antigen). Unless indicated otherwise, as used herein, "binding affinity" refers to intrinsic binding affinity which reflects a 1:1 interaction between members of a binding pair (e.g., antibody and antigen). The affinity of a molecule X for its partner Y can generally be represented by the dissociation constant (Kd). Affinity can be measured by common methods known in the art, including those described herein. Specific illustrative and exemplary embodiments for measuring binding affinity are described in the following.

An "affinity matured" antibody refers to an antibody with one or more alterations in one or more HVRs, compared to a parent antibody which does not possess such alterations, such alterations resulting in an improvement in the affinity of the antibody for antigen.

An antibody having a "biological characteristic" of a designated antibody is one which possesses one or more of the biological characteristics of that antibody which distinguish it from other antibodies that bind to the same antigen.

A "functional antigen binding site" of an antibody is one which is capable of binding a target antigen. The antigen binding affinity of the antigen binding site is not necessarily as strong as the parent antibody from which the antigen binding site is derived, but the ability to bind antigen must be measurable using any one of a variety of methods known for evaluating antibody binding to an antigen. Moreover, the antigen binding affinity of each of the antigen binding sites of a multivalent antibody herein need not be quantitatively the same. For the multimeric antibodies herein, the number of functional antigen binding sites can be evaluated using ultracentrifugation analysis as described in Example 2 of U.S. Patent Application Publication No. 2005/0186208 A1. According to this method of analysis, different ratios of target antigen to multimeric antibody are combined and the average molecular weight of the complexes is calculated assuming differing numbers of functional binding sites. These theoretical values are compared to the actual experimental values obtained in order to evaluate the number of functional binding sites.

A "species-dependent antibody" is one which has a stronger binding affinity for an antigen from a first mammalian species than it has for a homologue of that antigen from a second mammalian species. Normally, the species-dependent antibody "binds specifically" to a human antigen (i.e. has a binding affinity ($K_d$) value of no more than about $1\times10^{-7}$ M, preferably no more than about $1\times10^{-8}$ M and most preferably no more than about $1\times10^{-9}$ M) but has a binding affinity for a homologue of the antigen from a second nonhuman mammalian species which is at least about 50 fold, or at least about 500 fold, or at least about 1000 fold, weaker than its binding affinity for the human antigen. The species-dependent antibody can be any of the various types of antibodies as defined above. In some embodiments, the species-dependent antibody is a humanized or human antibody.

An "isolated" antibody is one which has been separated from a component of its natural environment. In some embodiments, an antibody is purified to greater than 95% or 99% purity as determined by, for example, electrophoretic (e.g., SDS-PAGE, isoelectric focusing (IEF), capillary electrophoresis) or chromatographic (e.g., ion exchange or reverse phase HPLC). For review of methods for assessment of antibody purity, see, e.g., Flatman et al., J. Chromatogr. B 848:79-87 (2007).

Fc Domains

The term "Fc domain", as used herein, generally refers to a monomer or dimer complex, comprising the C-terminal polypeptide sequences of an immunoglobulin heavy chain. The Fc domain may comprise native or variant Fc sequences. Although the boundaries of the Fc domain of an immunoglobulin heavy chain might vary, the human IgG heavy chain Fc domain is usually defined to stretch from an amino acid residue in the hinge region to the carboxyl terminus of the Fc sequence. The Fc sequence of an immunoglobulin generally comprises two constant regions, a CH2 region and a CH3 region, and optionally comprises a CH4 region. A human Fc domain may be obtained from any suitable immunoglobulin, such as the IgG1, IgG2, IgG3, or IgG4 subtypes, IgA, IgE, IgD or IgM.

Suitable Fc domains are prepared by recombinant DNA expression of pre-Fc chimeric polypeptides comprising 1) a signal peptide, obtained from a secreted or transmembrane protein, that is cleaved in front of a mature polypeptide having an N-terminal cysteine residue, contiguous with 2) an Fc domain polypeptide having an N-terminal cysteine residue.

Suitable examples of signal peptides are sonic hedgehog (SHH) (GenBank Acc. No. NM000193), IFNalpha-2 (IFN) (GenBank Acc. No. NP000596), and cholesterol ester transferase (CETP) (GenBank Accession No. NM000078). Other suitable examples include Indian hedgehog (Genbank Acc. No. NM002181), desert hedgehog (Genbank Acc. No. NM021044), IFNalpha-1 (Genbank Acc. No. NP076918), IFNalpha-4 (Genbank Acc. No. NM021068), IFNalpha-5 (Genbank Acc. No. NM002169), IFNalpha-6 (Genbank Acc. No. NM021002), IFNalpha-7 (Genbank Acc. No. NM021057), IFNalpha-8 (Genbank Acc. No. NM002170), IFNalpha-10 (Genbank Acc. No. NM002171), IFNalpha-13 (Genbank Acc. No. NM006900), IFNalpha-14 (Genbank Acc. No. NM002172), IFNalpha-16 (Genbank Acc. No. NM002173), IFNalpha-17 (Genbank Acc. No. NM021268) and IFNalpha-21 (Genbank Acc. No. NM002175).

Suitable examples of Fc domains and their pre-Fc chimeric polypeptides are shown in SEQ ID NO: 120 through SEQ ID NO: 215. The Fc domains are obtained by expressing the pre-Fc chimeric polypeptides in cells under conditions leading to their secretion and cleavage of the signal peptide. The pre-Fc polypeptides may be expressed in either prokaryotic or eukaryotic host cells. Preferably, mammalian host cells are transfected with expression vectors encoding the pre-Fc polypeptides.

Human IgG1 Fc domains having the N-terminal sequence CDKTHTCPPCPAPE, CPPCPAPE, and CPAPE are shown in SEQ ID NO: 120, SEQ ID NO: 128, and SEQ ID NO: 136, respectively, and the DNA sequences encoding them are shown in SEQ ID NO: 121, SEQ ID NO: 129, and SEQ ID NO: 137, respectively. The IgG1 domain of SEQ ID NO: 120 is obtained by expressing the pre-Fc chimeric polypeptides shown in SEQ ID NO: 122 (SHH signal peptide), SEQ ID NO: 124 (IFN signal peptide), and SEQ ID NO: 126 (CETP signal peptide), using the DNA sequences shown in SEQ ID NO: 123, SEQ ID NO: 125, and SEQ ID NO: 127, respectively. The IgG1 domain of SEQ ID NO: 128 is obtained by expressing the pre-Fc chimeric polypeptides shown in SEQ ID NO: 130 (SHH signal peptide), SEQ ID NO: 132 (IFN signal peptide), and SEQ ID NO: 134 (CETP signal peptide), using the DNA sequences shown in SEQ ID NO: 131, SEQ ID NO: 133, and SEQ ID NO: 135, respectively. The IgG1 domain of SEQ ID NO: 136 is obtained by expressing the pre-Fc chimeric polypeptides shown in SEQ ID NO: 138 (SHH signal peptide), SEQ ID NO: 140 (IFN signal peptide), and SEQ ID NO: 142 (CETP signal peptide), using the DNA sequences shown in SEQ ID NO: 139, SEQ ID NO: 141, and SEQ ID NO: 143, respectively.

Human IgG2 Fc domains having the N-terminal sequence CCVECPPCPAPE, CVECPPCPAPE, CPPCPAPE, and CPAPE are shown in SEQ ID NO: 144, SEQ ID NO: 152, SEQ ID NO: 160, and SEQ ID NO: 168, respectively, and the DNA sequences encoding them are shown in SEQ ID NO: 145, SEQ ID NO: 153, SEQ ID NO: 161, and SEQ ID NO: 169, respectively. The IgG2 domain of SEQ ID NO: 144 is obtained by expressing the pre-Fc chimeric polypeptides shown in SEQ ID NO: 146 (SHH signal peptide), SEQ ID NO: 148 (IFN signal peptide), and SEQ ID NO: 150 (CETP signal peptide), using the DNA sequences shown in SEQ ID NO: 147, SEQ ID NO: 149, and SEQ ID NO: 151, respectively. The IgG2 domain of SEQ ID NO: 152 is obtained by expressing the pre-Fc chimeric polypeptides shown in SEQ ID NO: 154 (SHH signal peptide), SEQ ID NO: 156 (IFN signal peptide), and SEQ ID NO: 158 (CETP signal peptide) using the DNA sequences shown in SEQ ID NO: 155, SEQ ID NO: 157, and SEQ ID NO: 159, respectively. The IgG2 domain of SEQ ID NO: 160 is obtained from the pre-Fc chimeric polypeptides shown in SEQ ID NO: 162 (SHH signal peptide), SEQ ID NO: 164 (IFN signal peptide), and SEQ ID NO: 166 (CETP signal peptide), using the DNA sequences shown in SEQ ID NO: 163, SEQ ID NO: 165, and SEQ ID NO: 167, respectively. The IgG2 domain of SEQ ID NO: 168 is obtained from the pre-Fc chimeric polypeptides shown in SEQ ID NO: 170 (SHH signal peptide), SEQ ID NO: 172 (IFN signal peptide), and SEQ ID NO: 174 (CETP signal peptide), using the DNA sequences shown in SEQ ID NO: 171, SEQ ID NO: 173, and SEQ ID NO: 175, respectively.

Human IgG3 Fc domains having the N-terminal sequence (CPRCPEPKSDTPPP) 3-CPRCPAPE, CPRCPAPE, and CPAPE are shown in SEQ ID NO: 176, SEQ ID NO: 184, and SEQ ID NO: 192, respectively, and the DNA sequences encoding them are shown in SEQ ID NO: 177, SEQ ID NO: 185, SEQ ID NO: 161, and SEQ ID NO: 193, respectively. The IgG3 domain of SEQ ID NO: 176 is obtained by expressing the pre-Fc chimeric polypeptides shown in SEQ ID NO: 178 (SHH signal peptide), SEQ ID NO: 180 (IFN signal peptide), and SEQ ID NO: 182 (CETP signal peptide), using the DNA sequences shown in SEQ ID NO: 179, SEQ ID NO: 181, and SEQ ID NO: 183, respectively. The IgG3 domain of SEQ ID NO: 184 is obtained by expressing the pre-Fc chimeric polypeptides shown in SEQ ID NO: 186 (SHH signal peptide), SEQ ID NO: 188 (IFN signal peptide), and SEQ ID NO: 190 (CETP signal peptide), using the DNA sequences shown in SEQ ID NO: 187, SEQ ID NO: 189, and SEQ ID NO: 191, respectively. The IgG3 domain of SEQ ID NO: 192 is obtained by expressing the pre-Fc chimeric polypeptides shown in SEQ ID NO: 194 (SHH signal peptide), SEQ ID NO: 196 (IFN signal peptide), and SEQ ID NO: 198 (CETP signal peptide), using the DNA sequences shown in SEQ ID NO: 195, SEQ ID NO: 197, and SEQ ID NO: 199, respectively.

The sequences of human IgG4 Fc domains having the N-terminal sequence CPSCPAPE and CPAPE are shown in SEQ ID NO: 200 and SEQ ID NO: 208, respectively, and the DNA sequences encoding them are shown in SEQ ID NO: 201 and SEQ ID NO: 209, respectively. The IgG4 domain of SEQ ID NO: 200 is obtained by expressing the pre-Fc chimeric polypeptides shown in SEQ ID NO: 202 (SHH signal peptide), SEQ ID NO: 204 (IFN signal peptide), and SEQ ID NO: 206 (CETP signal peptide), using the DNA sequences shown in SEQ ID NO: 203, SEQ ID NO: 205, and SEQ ID NO: 207, respectively. The IgG4 domain of SEQ ID NO: 208 is obtained by expressing the pre-Fc chimeric polypeptides shown in SEQ ID NO: 210 (SHH signal peptide), SEQ ID NO: 212 (IFN signal peptide), and SEQ ID NO: 214 (CETP signal peptide), using the DNA sequences shown in SEQ ID NO: 211, SEQ ID NO: 213, and SEQ ID NO: 215, respectively.

Suitable antibody variants having at their heavy chain N-terminus a cysteine residue are prepared by recombinant DNA expression of pre-heavy chain chimeric polypeptides comprising 1) a signal peptide, obtained from a secreted or transmembrane protein, that is cleaved in front of a mature polypeptide having an N-terminal cysteine residue, contiguous with 2) a antibody heavy chain polypeptide having an N-terminal cysteine residue.

Suitable antibody variants having at their light chain N-terminus a cysteine residue are prepared by recombinant DNA expression of pre-light chain chimeric polypeptides comprising 1) a signal peptide, obtained from a secreted or transmembrane protein, that is cleaved in front of a mature polypeptide having an N-terminal cysteine residue, contiguous with 2) a antibody light chain polypeptide having an N-terminal cysteine residue.

Trastuzumab heavy and light chains are obtained by expressing the pre-heavy and pre-light chimeric polypeptides in cells under conditions leading to their secretion and cleavage of the signal peptide. The pre-heavy chain and pre-light chain polypeptides may be expressed in either prokaryotic or eukaryotic host cells. Preferably, mammalian host cells are transfected with expression vectors encoding the pre-heavy chain and pre-light chain polypeptides.

Protein sequences added to the N-terminus of the aforementioned antibody heavy chain, pre-heavy chain, light chain, and pre-light chain variants are illustrated herein for the recombinant antibody trastuzumab, but are generally applicable to any recombinant antibody. DNA sequences encoding trastuzumab and its variants may be constructed and expressed in mammalian cells by cotransfecting DNA vectors for its heavy and light chains, and variants derived thereof, as described in U.S. Pat. No. 5,821,337 ("Immunoglobulin Variants") which is hereby incorporated by reference. The amino acid sequence of the wild-type trastuzumab light and heavy chains are shown in SEQ ID NO: 247 and SEQ ID NO: 248, respectively.

Suitable examples of trastuzumab light chains with N-terminal cysteine residues and their pre-Fc chimeric polypeptides are shown in SEQ ID NO: 249 through SEQ ID NO: 284. Suitable examples of trastuzumab heavy chains with N-terminal cysteine residues and their pre-Fc chimeric polypeptides are shown in SEQ ID NO: 285 through SEQ ID NO: 320.

Trastuzumab light chains having the N-terminal sequence C, CP, CPP, CPR, CPS, CDKT, CDKTHT, CVE, and CDTPPP are shown in SEQ ID NO: 249, SEQ ID NO: 253, SEQ ID NO: 257, SEQ ID NO: 261, SEQ ID NO: 265, SEQ ID NO: 269, SEQ ID NO: 273, SEQ ID NO: 277, and SEQ ID NO: 281, respectively. The light chain of SEQ ID NO: 249 is obtained by expressing the pre-light chimeric polypeptides shown in SEQ ID NO: 250 (SHH signal peptide), SEQ ID NO: 251 (IFN signal peptide), and SEQ ID NO: 252 (CETP signal peptide). The light chain of SEQ ID NO: 253 is obtained by expressing the pre-light chain chimeric polypeptides shown in SEQ ID NO: 254 (SHH signal peptide), SEQ ID NO: 255 (IFN signal peptide), and SEQ ID NO: 256

(CETP signal peptide). The light chain of SEQ ID NO: 257 is obtained by expressing the pre-light chimeric polypeptides shown in SEQ ID NO: 258 (SHH signal peptide), SEQ ID NO: 259 (IFN signal peptide), and SEQ ID NO: 260 (CETP signal peptide). The light chain of SEQ ID NO: 261 is obtained by expressing the pre-light chimeric polypeptides shown in SEQ ID NO: 262 (SHH signal peptide), SEQ ID NO: 263 (IFN signal peptide), and SEQ ID NO: 264 (CETP signal peptide). The light chain of SEQ ID NO: 265 is obtained by expressing the pre-heay light chimeric polypeptides shown in SEQ ID NO: 266 (SHH signal peptide), SEQ ID NO: 267 (IFN signal peptide), and SEQ ID NO: 268 (CETP signal peptide). The light chain of SEQ ID NO: 269 is obtained by expressing the pre-light chimeric polypeptides shown in SEQ ID NO: 270 (SHH signal peptide), SEQ ID NO: 271 (IFN signal peptide), and SEQ ID NO: 272 (CETP signal peptide). The light chain of SEQ ID NO: 273 is obtained by expressing the pre-light chimeric polypeptides shown in SEQ ID NO: 274 (SHH signal peptide), SEQ ID NO: 275 (IFN signal peptide), and SEQ ID NO: 276 (CETP signal peptide). The light chain of SEQ ID NO: 277 is obtained by expressing the pre-light chimeric polypeptides shown in SEQ ID NO: 278 (SHH signal peptide), SEQ ID NO: 279 (IFN signal peptide), and SEQ ID NO: 280 (CETP signal peptide). The light chain of SEQ ID NO: 281 is obtained by expressing the pre-light chimeric polypeptides shown in SEQ ID NO: 282 (SHH signal peptide), SEQ ID NO: 283 (IFN signal peptide), and SEQ ID NO: 284 (CETP signal peptide).

Trastuzumab heavy chains having the N-terminal sequence C, CP, CPP, CPR, CPS, CDKT, CDKTHT, CVE, and CDTPPP are shown in SEQ ID NO: 285, SEQ ID NO: 289, SEQ ID NO: 293, SEQ ID NO: 297, SEQ ID NO: 301, SEQ ID NO: 305, SEQ ID NO: 309, SEQ ID NO: 313, and SEQ ID NO: 317, respectively. The heavy chain of SEQ ID NO: 285 is obtained by expressing the pre-heavy chain chimeric polypeptides shown in SEQ ID NO: 286 (SHH signal peptide), SEQ ID NO: 287 (IFN signal peptide), and SEQ ID NO: 288 (CETP signal peptide). The heavy chain of SEQ ID NO: 289 is obtained by expressing the pre-heavy chain chimeric polypeptides shown in SEQ ID NO: 290 (SHH signal peptide), SEQ ID NO: 291 (IFN signal peptide), and SEQ ID NO: 292 (CETP signal peptide). The heavy chain of SEQ ID NO: 293 is obtained from the pre-heavy chain chimeric polypeptides shown in SEQ ID NO: 294 (SHH signal peptide), SEQ ID NO: 295 (IFN signal peptide), and SEQ ID NO: 296 (CETP signal peptide). The heavy chain of SEQ ID NO: 297 is obtained from the pre-heavy chain chimeric polypeptides shown in SEQ ID NO: 298 (SHH signal peptide), SEQ ID NO: 299 (IFN signal peptide), and SEQ ID NO: 300 (CETP signal peptide). The heavy chain of SEQ ID NO: 301 is obtained by expressing the pre-heavy chain chimeric polypeptides shown in SEQ ID NO: 302 (SHH signal peptide), SEQ ID NO: 303 (IFN signal peptide), and SEQ ID NO: 304 (CETP signal peptide). The heavy chain of SEQ ID NO: 305 is obtained by expressing the pre-heavy chain chimeric polypeptides shown in SEQ ID NO: 306 (SHH signal peptide), SEQ ID NO: 307 (IFN signal peptide), and SEQ ID NO: 308 (CETP signal peptide). The heavy chain of SEQ ID NO: 309 is obtained from the pre-heavy chain chimeric polypeptides shown in SEQ ID NO: 310 (SHH signal peptide), SEQ ID NO: 311 (IFN signal peptide), and SEQ ID NO: 312 (CETP signal peptide). The heavy chain of SEQ ID NO: 313 is obtained from the pre-heavy chain chimeric polypeptides shown in SEQ ID NO: 314 (SHH signal peptide), SEQ ID NO: 315 (IFN signal peptide), and SEQ ID NO: 316 (CETP signal peptide). The heavy chain of SEQ ID NO: 317 is obtained from the pre-heavy chain chimeric polypeptides shown in SEQ ID NO: 318 (SHH signal peptide), SEQ ID NO: 319 (IFN signal peptide), and SEQ ID NO: 320 (CETP signal peptide).

Suitable host cells include 293 human embryonic cells (ATCC CRL-1573) and CHO-K1 hamster ovary cells (ATCC CCL-61) obtained from the American Type Culture Collection (Rockville, Md.). Cells are grown at 37° C. in an atmosphere of air, 95%; carbon dioxide, 5%. 293 cells are maintained in Minimal essential medium (Eagle) with 2 mM L-glutamine and Earle's BSS adjusted to contain 1.5 g/L sodium bicarbonate, 0.1 mM non-essential amino acids, and 1.0 mM sodium pyruvate, 90%; fetal bovine serum, 10%. CHO-K1 cells are maintained in Ham's F12K medium with 2 mM L-glutamine adjusted to contain 1.5 g/L sodium bicarbonate, 90%; fetal bovine serum, 10%. Other suitable host cells include CV1 monkey kidney cells (ATCC CCL-70), COS-7 monkey kidney cells (ATCC CRL-1651), VERO-76 monkey kidney cells (ATCC CRL-1587), HELA human cervical cells (ATCC CCL-2), W138 human lung cells (ATCC CCL-75), MDCK canine kidney cells (ATCC CCL-34), BRL3A rat liver cells (ATCC CRL-1442), BHK hamster kidney cells (ATCC CCL-10), MMT060562 mouse mammary cells (ATCC CCL-51), and human $CD8^+$ T lymphocytes (described in U.S. Ser. No. 08/258,152 incorporated herein in its entirety by reference).

Examples of a suitable expression vectors are pCDNA3.1 (+) shown in SEQ ID NO: 216 and pSA shown in SEQ ID NO: 217. Plasmid pSA contains the following DNA sequence elements: 1) pBluescriptIIKS (+) (nucleotides 912-2941/1-619, GenBank Accession No. X52327), 2) a human cytomegalovirus promoter, enhancer, and first exon splice donor (nucleotides 63-912, GenBank Accession No. K03104), 3) a human alpha1-globin second exon splice acceptor (nucleotides 6808-6919, GenBank Accession No. J00153), 4) an SV40 T antigen polyadenylation site (nucleotides 2770-2533, Reddy et al. (1978) Science 200, 494-502), and 5) an SV40 origin of replication (nucleotides 5725-5578, Reddy et al., ibid). Other suitable expression vectors include plasmids pSVeCD4DHFR and pRKCD4 (U.S. Pat. No. 5,336,603), plasmid pIK.1.1 (U.S. Pat. No. 5,359,046), plasmid pVL-2 (U.S. Pat. No. 5,838,464), plasmid pRT43.2F3 (described in U.S. Ser. No. 08/258,152 incorporated herein in its entirety by reference).

Suitable expression vectors for human IgG pre-Fc polypeptides may be constructed by the ligation of a HindIII-PspOM1 vector fragment prepared from SEQ ID NO: 217, with a HindIII-EagI insert fragment prepared from SEQ ID NOs: 123, 125, 127, 131, 133, 135, 139, 141, 143, 147, 149, 151, 155, 157, 159, 163, 165, 167, 171, 173, 175, 179, 181, 183, 187, 189, 191, 195, 197, 199, 203, 205, 207, 211, 213, and 215.

Suitable selectable markers include the Tn5 transposon neomycin phosphotransferase (NEO) gene (Southern and Berg (1982) J. Mol. Appl. Gen. 1, 327-341), and the dihydrofolate reductase (DHFR) cDNA (Lucas et al. (1996) Nucl. Acids Res. 24, 1774-1779). One example of a suitable expression vector that incorporates a NEO gene is plasmid pSA-NEO, which is constructed by ligating a first DNA fragment, prepared by digesting SEQ ID NO: 218 with EcoRI and BglII, with a second DNA fragment, prepared by digesting SEQ ID NO: 217 with EcoRI and BglII. SEQ ID NO: 218 incorporates a NEO gene (nucleotides 1551 to 2345, Genbank Accession No. U00004) preceded by a sequence for translational initiation (Kozak (1991) J. Biol. Chem, 266, 19867-19870). Another example of a suitable expression vector that incorporates a NEO gene and a DHFR cDNA is plasmid pSVe-NEO-DHFR, which is constructed by ligating a first DNA fragment, prepared by digesting SEQ ID NO: 218 with EcoRI and BglII, with a second DNA fragment, prepared by digesting pSVeCD4DHFR with EcoRI and BglII. Plasmid pSVe-NEO-DHFR uses SV40 early promoter/enhancers to drive expression of the NEO gene and the DHFR cDNA. Other suitable selectable markers include the XPGT gene (Mulligan and Berg (1980) Science 209, 1422-1427) and the hygromycin resistance gene (Sugden et al. (1985) Mol. Cell. Biol. 5, 410-413).

In one embodiment, cells are transfected by the calcium phosphate method of Graham et al. (1977) J. Gen. Virol. 36, 59-74. A DNA mixture (10 ug) is dissolved in 0.5 ml of 1 mM Tris-HCl, 0.1 mM EDTA, and 227 mM CaCl2. The DNA mixture contains (in a ratio of 10:1:1) the expression vector DNA, the selectable marker DNA, and a DNA encoding the VA RNA gene (Thimmappaya et al. (1982) Cell 31, 543-551). To this mixture is added, dropwise, 0.5 mL of 50 mM Hepes (pH 7.35), 280 mM NaCl, and 1.5 mM NaPO4. The DNA precipitate is allowed to form for 10 minutes at 25° C., then suspended and added to cells grown to confluence on 100 mm plastic tissue culture dishes. After 4 hours at 37° C., the culture medium is aspirated and 2 ml of 20% glycerol in PBS is added for 0.5 minutes. The cells are then washed with serum-free medium, fresh culture medium is added, and the cells are incubated for 5 days.

In another embodiment, cells are transiently transfected by the dextran sulfate method of Somparyrac et al. (1981) Proc. Nat. Acad. Sci. 12, 7575-7579. Cells are grown to maximal density in spinner flasks, concentrated by centrifugation, and washed with PBS. The DNA-dextran precipitate is incubated on the cell pellet. After 4 hours at 37° C., the DEAE-dextran is aspirated and 20% glycerol in PBS is added for 1.5 minutes. The cells are then washed with serum-free medium, re-introduced into spinner flasks containing fresh culture medium with 5 micrograms/ml bovine insulin and 0.1 micrograms/ml bovine transferring, and incubated for 4 days.

Following transfection by either method, the conditioned media is centrifuged and filtered to remove the host cells and debris. The sample contained the Fc domain is then concentrated and purified by any selected method, such as dialysis and/or column chromatography (see below). To identify the Fc domain in the cell culture supernatant, the culture medium is removed 24 to 96 hours after transfection, concentrated, and analyzed by SDS-polyacrylamide gel electrophoresis (SDS-PAGE) in the presence or absence of a reducing agent such as dithiothreitol.

For unamplified expression, plasmids are transfected into human 293 cells (Graham et al., J. Gen. Virol. 36:59 74 (1977)), using a high efficiency procedure (Gorman et al., DNA Prot. Eng. Tech. 2:3 10 (1990)). Media is changed to serum-free and harvested daily for up to five days. For unamplified expression, plasmids are transfected into human 293 cells (Graham et al., J. Gen. Virol. 36:59 74 (1977)), using a high efficiency procedure (Gorman et al., DNA Prot. Eng. Tech. 2:3 10 (1990)). Media is changed to serum-free and harvested daily for up to five days. The Fc domains are purified from the cell culture supernatant using HiTrap Protein A HP (Pharmacia). The eluted Fc domains are buffer-exchanged into PBS using a Centricon-30 (Amicon), concentrated to 0.5 ml, sterile filtered using a Millex-GV (Millipore) at 4° C.

Fc Domain Modifications Altering Fc Receptor Binding and/or Effector Function

In certain embodiments, the Fc domain is engineered to have altered binding affinity to an Fc receptor and/or altered effector function, as compared to a non-engineered Fc domain. Embodiments of said modifications are described in U.S. Patent Application Publication No. US 20130058937 A1 and in the paragraphs that follow.

Binding to Fc receptors can be easily determined e.g. by ELISA, or by Surface Plasmon Resonance (SPR) using standard instrumentation such as a BIAcore instrument (GE Healthcare), and Fc receptors such as may be obtained by recombinant expression. A suitable such binding assay is described herein. Alternatively, binding affinity of Fc domains or tetrahedral antibodies comprising an Fc domain for Fc receptors may be evaluated using cell lines known to express particular Fc receptors, such as NK cells expressing FcγIIIa receptor.

Effector function of an Fc domain, can be measured by methods known in the art. Suitable in vitro assays to assess ADCC activity of a molecule of interest are described in PCT publication no. WO 2006/082515 or PCT patent application no. PCT/EP2012/055393, incorporated herein by reference in their entirety. Useful effector cells for such assays include peripheral blood mononuclear cells (PBMC) and Natural Killer (NK) cells. Alternatively, or additionally, ADCC activity of the molecule of interest may be assessed in vivo, e.g. in a animal model such as that disclosed in Clynes et al., Proc Natl Acad Sci USA 95, 652-656 (1998).

In some embodiments binding of the Fc domain to a complement component, specifically to C1q, is altered. Accordingly, in some embodiments wherein the Fc domain is engineered to have altered effector function, said altered effector function includes altered CDC. C1q binding assays may be carried out to determine whether the Fc domain is able to bind C1q and hence has CDC activity. See e.g., C1q and C3c binding ELISA in WO 2006/029879 and WO 2005/100402. To assess complement activation, a CDC assay may be performed (see, for example, Gazzano-Santoro et al., J Immunol Methods 202, 163 (1996); Cragg et al., Blood 101, 1045-1052 (2003); and Cragg and Glennie, Blood 103, 2738-2743 (2004))

Fc Variants

The present invention is directed to the generation of multispecific, particularly bispecific binding proteins, and in particular, multispecific antibodies. The present invention generally relies on the use of engineered or variant Fc domains that can self-assemble in production cells to produce heterodimeric proteins, and methods to generate and purify such heterodimeric proteins.

Furthermore, as outlined herein, additional amino acid variants may be introduced into the Fc domains of the invention, to add additional functionalities. For example, amino acid changes within the Fc region can be added (either to one monomer or both) to facilitate increased ADCC or CDC (e.g. altered binding to Fcγ receptors); to allow or increase yield of the addition of toxins and drugs (e.g. for ADC), as well as to increase binding to FcRn and/or increase serum half-life of the resulting molecules. As is further described herein and as will be appreciated by those in the art, any and all of the variants outlined herein can be optionally and independently combined with other variants. Similarly, another category of functional variants are "Fcγ ablation variants" or "Fcγ silencing variants". In these embodiments, for some therapeutic applications, it is desirable to reduce or remove the normal binding of the Fc domain to one or more or all of the Fcγ receptors (e.g. FcγRI, FcγRIIa, FcγRIIb, FcγRIIIa, etc.) to avoid additional mechanisms of action. That is, for example, in many embodiments, particularly in the use of bispecific antibodies that bind CD3 monovalently and a tumor antigen on the other (e.g. CD19, her2/neu, etc.), it is generally desirable to ablate FcγRIIIa binding to eliminate or significantly reduce ADCC activity.

Additional Fc Variants for Additional Functionality

Accordingly, there are a number of useful Fc substitutions that can be made to alter binding to one or more of the FcγR receptors. Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, Kabat positions 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, there are additional Fc substitutions that find use in increased binding to the FcRn receptor and increased serum half-life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

Antigen Binding Domains

As will be appreciated by a skilled artisan, there are two basic types of antigen binding domains, those that resemble antibody and T cell antigen binding domains (e.g. comprising a set of six CDRs, or in the case of single domain antibodies, single domain T cell receptors and the like, three CDRs) and those that can be otherwise be "ligand binding partners" (i.e. ligands or receptors, enzymes or substrates, or their equivalents), for example, that bind to targets without the use of CDRs.

Fab Domains

A challenge in the production of multispecific antibodies is formation of various undesired side products apart from the desired functional molecule. When two or more distinct Fab domains are present, mispairing generally results from the pairing of wrong heavy chains with each other as well as pairing of a light chain with a wrong heavy chain counterpart or undesired pairing of light chains. The light chain mispairing problem is particularly challenging, and to date, no single approach by itself has proven consistent in preventing improper association of light chains with heavy chains and/or the formation of other side-products.

One approach that has been useful in forcing the pairing of a light chain polypeptide with its correct heavy chain counterpart utilizes chimeric heavy and light chains. Originally described as "variable region domain exchanged IgG", or "inside-out (io) antibodies", this approach is based upon intradomain crossovers between heavy and light chains involving the exchange of the heavy and light variable regions within a particular Fab domain (Chan et al, Molecular Immunology 421, 527-538 (2004)).

This approach, also known as "CrossMab technology", has been used to make distinct domain crossovers between heavy and light chains thereby creating different domain arrangements for heavy chains and light chains of different specificity. WO 2009/080251, WO 2009/080252, WO 2009/080253, WO 2009/080254 relate to bivalent, bispecific IgG antibodies with such domain crossovers. WO 2010/145792 and WO 2010/145792 relate to tetravalent antigen binding proteins with such domain crossovers. Multispecific antibodies with such a domain exchange in one binding arm (CrossMabVH-VL) are described in WO2009/080252 and Schaefer et al, PNAS, 108 (2011) 11187-1191. (All of the aforementioned citations are incorporated herein by reference in their entirety).

Variable region domain exchanges generally reduce but do not eliminate the byproducts due to the mismatch of a light chain against a first antigen with the wrong heavy chain against the second antigen. Moreover, the preparations are not completely free of other side products. The main side product is based on a Bence-Jones-type interaction (see also Schaefer, W. et al, PNAS, 108 (2011) 11187-1191; in FIG. S1I of the Supplement).

Further reduction of side products and the associated aggregation behavior to improve the yield of such multispecific antibodies has been aided by the introduction of substitutions of charged amino acids with the opposite charge at specific amino acid positions in the VH and CL domains, as well as the CH1 and CL domains. The resulting "charge pair" modifications mediate electrostatic steering effects are complementary to the effect of variable region domain exchanges in helping to force the correct pairing of a light chain with its correct heavy chain.

Amino acid substitutions that find use in the present invention as constituents of such charge pairs include those described in Kannan et al (WO2014/081955), Shaefer et al (WO2015/150447), Ast et al (WO/2016/020309, and Carter et al (WO2016/172485), hereby incorporated by reference in their entirety. Preferred variants that find use include, but are not limited to, EU positions E123, Q124 and V133 in kappa and lambda light chain constant regions, K147, S183 and K213 in heavy chain constant regions, Q38 in light chain variable regions, and Q39 in the heavy chain variable regions. Specific examples of amino acid substitutions include, but are not limited to, substitution at position 123 or 124 in light chain constant regions by K, R or H, at position 147 or 213 in heavy chain constant regions by E or D, substitution at position 133 in light chain constant regions by K, R, H, E or D, substitution at position 183 in heavy chain constant regions by K, R, H, E or D, at position 38 in light chain variable regions by K, R, H, E or D, and at position 39 in heavy chain variable regions by K, R, H, E or D.

This invention provides tetrahedral antibodies comprising two types of heavy chains and two types of light chains. In such antibodies, the third and fourth domains may comprise one or more charge pairs, while the fifth and sixth domains are a "CrossMab." Conversely, the third and fourth domains may be a "CrossMab," while the fifth and sixth domains comprise one or more charge pairs. Further, the third and fourth domains may be a "CrossMab" and comprise one or more charge pairs, while the fifth and sixth domains comprise neither such modifications. Conversely, the fifth and sixth domains may be a "CrossMab" and comprise one or more charge pairs, while the third and fourth domains comprise neither such modifications. In each case, such modifications facilitate correct pairing between the two types of heavy chains with their corresponding light chains. Such tetrahedral antibodies may be bispecific and tetravalent.

Similarly, this invention provides octahedral antibodies comprising two types of heavy chains and two types of light chains. In such antibodies, the fourth, fifth, and sixth domains may comprise one or more charge pairs, while the seventh, eighth, and ninth domains are a “CrossMab.” Conversely, the fourth, fifth, and sixth domains may be a “CrossMab,” while the seventh, eighth, and ninth comprise one or more charge pairs. Further, the fourth, fifth, and sixth domains may be a “CrossMab” and comprise one or more charge pairs, while the seventh, eighth, and ninth domains comprise neither such modifications. Conversely, the seventh, eighth, and ninth domains may be a “CrossMab” and comprise one or more charge pairs, while the fourth, fifth, and sixth domains comprise neither such modifications. In each case, such modifications facilitate correct pairing between the two types of heavy chains with their corresponding light chains. Such antibodies may be bispecific and octavalent.

SEQ ID NOs: 5105-7764 provide the sequences of the V region and CDRs of antibodies which may be used in the present invention. Accordingly, the Fab domains of the invention may comprise any of the V regions and/or CDRs provided in SEQ ID NOs 5105-7764.

In any of the tetrahedral antibodies of the invention wherein the first domain is an Fc domain, and the second, third, and fourth domains are Fab domain, in an embodiment:

a) the third and fourth domains comprise a first type of Fab and the second domain comprise a second type of Fab,
   i) the first type of Fab is formed by a VH-CH on a H1 or H2 chain, and a VL-CL on a L1 chain, and the second type of Fab is formed by a VL-CH on a H1 chain, and a VH-CL domain on a L2 chain;
   ii) the first type of Fab is formed by a VL-CH on a H1 or H2 chain, and a VH-CL on a L1 chain, and the second type of Fab is formed by a VH-CH on a H2 chain, and a VL-CL domain on a L2 chain, or
   iii) the first type of Fab is formed by a VH-CH on a H1 or H2 chain, and VL-CL on a L1 chain, and the second type of Fab is formed by a VH-CH on a H2 chain, and a VL-CL domain on a L2 chain, wherein VL is a kappa and/or lambda light chain V region.

In any of the tetrahedral antibodies of the invention wherein the third, fourth, fifth, and sixth domains are Fab domains, in an embodiment:

a) the third and fourth domain comprise a first type of Fab, and the fifth and/or sixth domain comprise a second type of Fab, and
   i) the first type of Fab is formed by a VH-CH on a H1 chain, and a VL-CL domain on a L1 chain, and the second type of Fab is formed by a VL-CH on a H2 chain, and a VH-CL on a L2 chain;
   ii) the first type of Fab is formed by a VL-CH on a H1 chain, and a VH-CL domain on a L1 chain, and the second type of Fab is formed by a VH-CH on a H2 chain, and a VL-CL on a L2 chain; or
   iii) the first type of Fab is formed by a VH-CH on a H1 chain, and a VL-CL domain on a L1 chain, and the second type of Fab is formed by a VH-CH on a H2 chain, and a VL-CL on a L2 chain, wherein VL is a kappa and/or lambda light chain V region.

In any tetrahedral antibodies of the invention:

a) one type of Fab comprises the mutations Q39K and S183E in its heavy chain portion, and the mutations Q38E and V133K in its light chain portion, and the other type of Fab comprises the mutations S183K and Q38E in its heavy chain portion, and the mutations V133E and Q39K in its light chain portion;
b) one type of Fab comprises the mutations Q39K and S183E in its heavy chain portion, and the mutations Q38E and V133K in its light chain portion, and the other type of Fab comprises the mutations S183K and Q38K in its heavy chain portion, and the mutations V133E and Q39E in its light chain portion;
c) one type of Fab comprises the mutations Q39E and S183E in its heavy chain portion, and the mutations Q38E and V133K in its light chain portion, and the other type of Fab comprises the mutations S183K and Q38E in its heavy chain portion, and the mutations V133E and Q39K in its light chain portion;
d) one type of Fab comprises the mutations Q39E and S183E in its heavy chain portion, and the mutations Q38K and V133K in its light chain portion, and the other type of Fab comprises the mutations S183K and Q38K in its heavy chain portion, and the mutations S176E and Q39E in its light chain portion;
e) one type of Fab comprises the mutations Q39K and S183E in its heavy chain portion, and the mutations Q38E and S176K in its light chain portion, and the other type of Fab comprises the mutations S183K and Q38E in its heavy chain portion, and the mutations S176E and Q39K in its light chain portion;
f) one type of Fab comprises the mutations Q39K and S183E in its heavy chain portion, and the mutations Q38E and S176K in its light chain portion, and the other type of Fab comprises the mutations S183K and Q38K in its heavy chain portion, and the mutations S176E and Q39E in its light chain portion;
g) one type of Fab comprises the mutations Q39E and S183E in its heavy chain portion, and the mutations Q38E and S176K in its light chain portion, and the other type of Fab comprises the mutations S183K and Q38E in its heavy chain portion, and the mutations S176E and Q39K in its light chain portion; or
h) one type of Fab comprises the mutations Q39E and S183E in its heavy chain portion, and the mutations Q38K and S176K in its light chain portion, and the other type of Fab comprises the mutations S183K and Q38K in its heavy chain portion, and the mutations S176E and Q39E in its light chain portion.

Extracellular Proteins

Extracellular proteins play important roles in, among other things, the formation, differentiation and maintenance of multicellular organisms. A discussion of various intracellular proteins of interest is set forth in U.S. Pat. No. 6,723,535, Ashkenazi et al., issued Apr. 20, 2004, hereby incorporated by reference. Extracellular proteins include secreted proteins and the extracellular domains of transmembrane proteins.

Secreted Proteins

The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. These secreted polypeptides or signaling molecules normally pass through the cellular secretory pathway to reach their site of action in the extracellular environment.

Secreted proteins have various industrial applications, including as pharmaceuticals, diagnostics, biosensors and bioreactors. Most protein drugs available at present, such as thrombolytic agents, interferons, interleukins, erythropoietins, colony stimulating factors, and various other cytokines, are secretory proteins. Their receptors, which are membrane proteins, also have potential as therapeutic or diagnostic agents. Efforts are being undertaken by both industry and academia to identify new, native secreted proteins. Many efforts are focused on the screening of mammalian recombinant DNA libraries to identify the coding sequences for novel secreted proteins. Examples of screening methods and techniques are described in the literature (see, for example, Klein et al., Proc. Natl. Acad. Sci. 93:7108-7113 (1996); U.S. Pat. No. 5,536,637)).

Interleukin-15 (IL-15) is a member of the gamma cytokine family that stimulates the proliferation of T, B, and natural killer (NK) cells and induces stem, central and effector memory CD8 T cells. The sequence of IL-15 is described in Grabstein et al., Science. 1994 May 13; 264 (5161): 965-8. The biology of IL-15 and its therapeutic implications are discussed, for example, in Steel et al. Trends Pharmacol Sci. 2012 January; 33 (1): 35-41, Perera et al. Microbes Infect. 2012 March; 14 (3): 247-261, and Waldmann et al. Nature Reviews Immunology volume 6, pages 595-601 (2006).

Extracellular Domains of Transmembrane Proteins

Membrane-bound proteins and receptors can play important roles in, among other things, the formation, differentiation, and maintenance of multicellular organisms. The fate of many individual cells, e.g., proliferation, migration, differentiation, or interaction with other cells, is typically governed by information received from other cells and/or the immediate environment. This information is often transmitted by secreted polypeptides (for instance, mitogenic factors, survival factors, cytotoxic factors, differentiation factors, neuropeptides, and hormones) which are, in turn, received and interpreted by diverse cell receptors or membrane-bound proteins. Such membrane-bound proteins and cell receptors include, but are not limited to, cytokine receptors, receptor kinases, receptor phosphatases, receptors involved in cell-cell interactions, and cellular adhesin molecules like selectins and integrins. For instance, transduction of signals that regulate cell growth and differentiation is regulated in part by phosphorylation of various cellular proteins. Protein tyrosine kinases, enzymes that catalyze that process, can also act as growth factor receptors. Examples include fibroblast growth factor receptor and nerve growth factor receptor.

Membrane-bound proteins and receptor molecules have various industrial applications, including as pharmaceutical and diagnostic agents. Receptor immunoadhesins, for instance, can be employed as therapeutic agents to block receptor-ligand interactions. The membrane-bound proteins can also be employed for screening of potential peptide or small molecule inhibitors of the relevant receptor/ligand interaction.

The tumor necrosis factor receptor superfamily (TNFRSF) is a protein superfamily of cytokine receptors characterized by the ability to bind tumor necrosis factors (TNFs) via an extracellular cysteine-rich domain. Members of the TNFRSF are described in Locksley et al., Cell. 2001 Feb. 23; 104 (4): 487-501 and the table reproduced below. See also Hehlgans et al., Immunology. 2005 May; 115 (1): 1-20.

TABLE B-1

Members of the TNFR Superfamily

| Receptor | Standardized | Other Names | Accession | Human Chromosome | Mouse Chromosome |
|---|---|---|---|---|---|
| NGFR | TNFRSF16 | p75 | M14764 | 17q21-q22 | 11, 55.6 cM |
| Troy | TNFRSF19 | Taj | AF167555 | 13q12.11-12.3 | 14 |
| EDAR | | | AF130988 | 2q11-q13 | 10, 29.0 cM |
| XEDAR | | EDA-A2R | | AF298812 | X |
| CD40 | TNFRSF5 | p50, Bp50 | X60592 | 20q12-q13.2 | 2, 97.0 cM |
| DcR3 | TNFRSF6B | | AF104419 | 20q13 | |
| FAS | TNFRSF6 | CD95, APO-1, APT1 | M67454 | 10q24.1 | 19, 23.0 cM |
| OX40 | TNFRSF4 | CD134, ACT35, TXGP1L | X75962 | 1p36 | 4, 79.4 cM |
| AITR | TNFRSF18 | GITR | AF125304 | 1p36.3 | 4 |
| CD30 | TNFRSF8 | Ki-1, D1S166E | M83554 | 1p36 | 4, 75.5 cM |
| HveA | TNFRSF14 | HVEM, ATAR, TR2, LIGHTR | U70321 | 1p36.3-p36.2 | |
| 4-1BB | TNFRSF9 | CD137, ILA | L12964 | 1p36 | 4, 75.5 cM |
| TNFR2 | TNFRSF1B | CD120b, p75, TNFBR, TNFR80, TNF-R-II | M32315 | 1p36.3-p36.2 | 4, 75.5 cM |
| DR3 | TNFRSF12 | TRAMP, WSL-1, LARD, WSL-LR, DDR3, TR3, APO-3 | U72763 | 1p36.2 | |
| CD27 | TNFRSF7 | Tp55, S152 | M63928 | 12p13 | 6, 60.35 cM |
| TNFR1 | TNFRSF1A | CD120a p55-R, TNFAR TNFR60 TNF-R-I | M75866 | 12p13.2 | 6, 60.55 cM |
| LTβR | TNFRSF3 | TNFR2-RP, TNFCR, TNF-R-III | L04270 | 12p13 | 6, 60.4 cM |
| RANK | TNFRSF11A | TRANCE-R | AF018253 | 18q22.1 | |
| TACI | | CAML interactor | | AF023614 | 17p11 |
| BCMA | TNFRSF17 | BCM | Z29574 | 16p13.1 | |
| DR6 | | TR7 | NM 014452 | 6p21.1-12.2 | |
| OPG | TNFRSFHB | OCIF, TR1 osteoprotegerin | U94332 | 8Q24 | |
| DR4 | TNFRSF10A | Apo2, TRAILR-1 | U90875 | 8p21 | |

TABLE B-1-continued

| Members of the TNFR Superfamily | | | | | |
|---|---|---|---|---|---|
| Receptor | Standardized | Other Names | Accession | Human Chromosome | Mouse Chromosome |
| DR5 | TNFRSF10B | KILLER, TRICK2A, TRAIL-R2, TRICKB | AF012628 | 8p22-p21 | |
| DcR1 | TNFRSF10C | TRAILR3, LIT, TRID | AF012536 | 8p22-p21 | |
| DcR2 | TNFRSF10D | TRUNDD TRAILR4 | AF029761 | 8p21 | |

The immunoglobulin superfamily (IgSF) is a large protein superfamily of cell surface and soluble proteins that are involved in the recognition, binding, or adhesion processes of cells. The IgSF is discussed in Natarajan et al. (April 2015) Immunoglobulin Superfamily. In: eLS. John Wiley & Sons, Ltd: Chichester.

Angiotensin-converting enzyme 2 (ACE2) is an enzyme attached to the cell membranes of cells in the lungs, arteries, heart, kidney, and intestines. ACE2 is discussed in Donoghue, et al., 2000. Circulation research, 87 (5), pp. e1-e9.

Extracellular proteins of the invention are provided in SEQ ID NOs: 847-890 and 935-2038. SEQ ID NOs: 891-934 and 2039-3142 provide the sequences of extracellular domains that also include the sequence of the signal peptide (SP) and pre-protein (PP) sequence.

Intracellular Binding Domains

Suitable examples of intracellular binding domains of the invention are the complete intracellular regions, portions thereof, or derivatives thereof of CD3 zeta chain (UniProtKB CD3Z_HUMAN; GenBank Accession No. P20963), CD3 epsilon chain (UniProtKB CD3E_HUMAN; GenBank Accession No. P07766), CD28 (UniProtKB CD28_HUMAN; GenBank Accession No. P10747), ICOS (UniProtKB ICOS_HUMAN, GenBank Accession No. Q9Y6W8), TNFRSF1 (UniProtKB TNR1A_HUMAN, GenBank Accession No. P19438), TNFRSF1B (UniProtKB TNR1B_HUMAN, GenBank Accession No. P20333), LTBR (UniProtKB TNR3_HUMAN, GenBank Accession No. Q36941), OX40 (UniProtKB TNR4_HUMAN, GenBank Accession No. P43489), CD40 (UniProtKB TNR5_HUMAN, GenBank Accession No. P25942), FasR (UniProtKB TNR6_HUMAN, GenBank Accession No. P25445), DCR3 (UniProtKB TNR6B_HUMAN, GenBank Accession No. 095407), CD27 (UniProtKB CD27_HUMAN, GenBank Accession No. 26842), CD30 (UniProtKB TNR8_HUMAN, GenBank Accession No. P28908), 4-1BB (UniProtKB TNR9_HUMAN, GenBank Accession No. Q07011), DR4 (UniProtKB TR10A_HUMAN, GenBank Accession No. O00220), DR5 (UniProtKB TR10B_HUMAN, GenBank Accession No. 014763), DCR2 (UniProtKB TR10D_HUMAN, GenBank Accession No. Q9UBN6), RANK (UniProtKB TNR11_HUMAN, GenBank Accession No. Q9Y6Q6), TWEAK-R (UniProtKB TNR12_HUMAN, GenBank Accession No. Q9NP84), TACI (UniProtKB TR13B_HUMAN, GenBank Accession No. O14836), BAFF-R (UniProtKB TR13C_HUMAN, GenBank Accession No. Q96RJ3), HVEM (UniProtKB TNR14_HUMAN; GenBank Accession No. Q92956), p75NTR (UniProtKB TNR16_HUMAN, GenBank Accession No. P08138), BCMA (UniProtKB TNR17_HUMAN; GenBank Accession No. Q02223), GITR (UniProtKB TNR18_HUMAN; GenBank Accession No. Q9Y5U5), TROY (UniProtKB TNR19_HUMAN; GenBank Accession No. Q9NS68), DR6 (UniProtKB TNR21_HUMAN; GenBank Accession No. 075509), DR3 (UniProtKB TNR25_HUMAN; GenBank Accession No. Q93038), XEDAR (UniProtKB TNR27_HUMAN; GenBank Accession No. Q9HAV5), CD8a (UniProtKB CD8A_HUMAN; GenBank Accession No. P01732), CD8b (UniProtKB CD8B_HUMAN; GenBank Accession No. P10966). The sequences of each of these proteins are hereby incorporated by reference.

Another preferred class of intracellular binding domains are antigens and neo-antigens, more particularly peptide fragments and derivatives thereof.

Transmembrane Domains

Suitable examples of transmembrane domains of the invention are the complete transmembrane regions, portions thereof, or derivatives thereof of ACE2 (UniProtKB ACE2_HUMAN; GenBank Accession No. Q9BYF1), Collectrin (UniProtKB CLTRN_HUMAN; GenBank Accession No. Q9HBJ8), CD8a (UniProtKB CD8A_HUMAN; GenBank Accession No. P01732), CD8b (UniProtKB CD8B_HUMAN; GenBank Accession No. P10966), CD3 zeta chain (UniProtKB CD3Z_HUMAN; GenBank Accession No. P20963), CD3 epsilon chain (UniProtKB CD3E_HUMAN; GenBank Accession No. P07766), CD28 (UniProtKB CD28_HUMAN; GenBank Accession No. P10747), ICOS (UniProtKB ICOS_HUMAN, GenBank Accession No. Q9Y6W8), TNFRSF1 (UniProtKB TNRIA_HUMAN, GenBank Accession No. P19438), TNFRSF1B (UniProtKB TNR1B_HUMAN, GenBank Accession No. P20333), LTBR (UniProtKB TNR3_HUMAN, GenBank Accession No. Q36941), OX40 (UniProtKB TNR4_HUMAN, GenBank Accession No. P43489), CD40 (UniProtKB TNR5_HUMAN, GenBank Accession No. P25942), FasR (UniProtKB TNR6_HUMAN, GenBank Accession No. P25445), DCR3 (UniProtKB TNR6B_HUMAN, GenBank Accession No. 095407), CD27 (UniProtKB CD27_HUMAN, GenBank Accession No. 26842), CD30 (UniProtKB TNR8_HUMAN, GenBank Accession No. P28908), 4-1BB (UniProtKB TNR9_HUMAN, GenBank Accession No. Q07011), DR4 (UniProtKB TR10A_HUMAN, GenBank Accession No. O00220), DR5 (UniProtKB TR10B_HUMAN, GenBank Accession No. 014763), DCR2 (UniProtKB TR10D_HUMAN, GenBank Accession No. Q9UBN6), RANK (UniProtKB TNR11_HUMAN, GenBank Accession No. Q9Y6Q6), TWEAK-R (UniProtKB TNR12_HUMAN, GenBank Accession No. Q9NP84), TACI (UniProtKB TR13B_HUMAN, GenBank Accession No. 014836), BAFF-R (UniProtKB TR13C_HUMAN, GenBank Accession No. Q96RJ3), HVEM (UniProtKB TNR14_HUMAN; GenBank Accession No. Q92956), p75NTR (UniProtKB TNR16_HUMAN, GenBank Accession No. P08138), BCMA (UniProtKB TNR17_HUMAN; GenBank Accession No. Q02223), GITR (UniProtKB TNR18_HUMAN; GenBank Accession No. Q9Y5U5), TROY (UniProtKB TNR19_HUMAN; GenBank Accession No. Q9NS68), DR6 (UniProtKB TNR21_HUMAN; GenBank Accession No. 075509), DR3 (UniProtKB TNR25_HUMAN; GenBank Accession No. Q93038), XEDAR (UniProtKB TNR27_HUMAN; GenBank Accession No. Q9HAV5), TNFSF1 (UniProtKB TNFB_HUMAN, GenBank Accession No. P01374), TNFSF2 (UniProtKB TNFA_HUMAN, GenBank Accession No. P01375), TNFSF3 (UniProtKB TNFC_HUMAN, GenBank Accession No. Q06643), TNFSF4 (UniProtKB TNFL4_HUMAN, GenBank Accession No. P23510), TNFSF5 (UniProtKB CD40L_HUMAN, GenBank Accession No. P29965), TNFSF6 (UniProtKB TNFL6_HUMAN, GenBank Accession No. P48023), TNFSF7 (UniProtKB CD70_HUMAN, GenBank Accession No. P32970), TNFSF8 (UniProtKB TNFL8_HUMAN, GenBank Accession No. P32971), TNFSF9 (UniProtKB TNFL9_HUMAN, GenBank Accession No. P41273), TNFSF10 (UniProtKB TNF10_HUMAN, GenBank Accession No. P50591), TNFSF11 (UniProtKB TNF11_HUMAN, GenBank Accession No. O14788), TNFSF12 (UniProtKB TNF12_HUMAN, GenBank Accession No. O43508), TNFSF13 (UniProtKB TNF13_HUMAN, GenBank Accession No. O75888), TNFSF13B (UniProtKB TN13B_HUMAN, GenBank Accession No. Q9Y275), TNFSF14 (UniProtKB TNF14_HUMAN; GenBank Accession No. 043557), TNFSF15 (UniProtKB TNF15_HUMAN, GenBank Accession No. 095150), and TNFSF18 (UniProtKB TNF18_HUMAN; GenBank Accession No. Q9UNG2). The sequences of each of these proteins are hereby incorporated by reference.

Covalent Linkages

Covalent linkages of the invention may comprise, or consist of, any "non-peptidyl linkage" described in U.S. Patent Application Publication No. US20170008950 A1, published Jan. 12, 2017, the contents of which are hereby incorporated-by-reference.

Peptide Linkers

Peptide linkers are stretches of consecutive amino acids which link two domains.

In one embodiment, the peptide linker has a length of at least 5 amino acids. In one embodiment, the peptide linker has a length of 5-100 amino acids.

In one embodiment, the peptide linker has a length of 10-50 amino acids.

In one embodiment, peptide linkers have a length of 23 amino acids. In one embodiment, the peptide linker connecting domain 1 and a dimerizing polypeptide and the peptide linker connecting domains 2 and a dimerizing polypeptide each have a length of 23 amino acids. In one embodiment, such peptide linkers each have a length of 23 amino acids and are derived from the stalk region of a TNF receptor, preferably wherein the TNF receptor is TNF receptor 1B, still more preferably wherein the peptide linker consists of the amino acid sequence set forth in SEQ ID NO: 4468.

In one embodiment, the peptide linker is a stretch of consecutive amino acids found in an immunoglobulin hinge region or portion thereof.

In one embodiment, the peptide linker is a stretch of 5 to 57 consecutive amino acids found in the sequence:

```
                                     (SEQ ID NO: 3227)
TSTSPTRSMAPGAVHLPQPVSTRSQHTQPTPEPSTAPSTSFLLPMGPSPP

AEGSTGD
```

In one embodiment, the peptide linker is a glycine-serine or glycine-alanine linker.

In one embodiment, the peptide linker is a) (GxS)n or (GxS)nGm or (GxA)n or (GxA)nGm b) with G=glycine, S=serine, A=alanine, and c) x=3, n=2, 3, 4, 5 or 6, m=0, 1, 2 or 3; or d) x=4, n=1, 2, 3, 4 or 5, m=0, 1, 2 or 3.

Exemplary linkers of the invention are provided in SEQ ID NOs: 3143-4656.

Intra-Homodimerization and Intra-Heterodimerization within Domains

Fc Domain Modifications Promoting Heterodimerization

The invention provides tetrahedral antibodies, wherein the first and second domains each comprise two polypeptide chains, such that there are two N-termini and two C-termini upon which additional domains may be attached either directly by a peptide bond or via a peptide linker). Similarly, the invention provides octahedral antibodies, wherein the first, second and third domains each comprise two polypeptide chains, such that there are two are two N-termini and two C-termini upon which additional domains may be attached either directly by a peptide bond or via a peptide linker). Other domains of the invention (such as the third, fourth, fifth, sixth, seventh, and eighth domains of a tetrahedral antibody, and the fourth, fifth, sixth, seventh, eighth, ninth, tenth, eleventh, and twelfth domains of an octahedral antibody) may also comprise two polypeptide chains.

In particular embodiments, such domains are Fc domains comprising a modification promoting association of two different Fc domain subunits, i.e. intra-heterodimerization. A modification may be present in the first Fc domain subunit and/or the second Fc domain subunit. Embodiments of said modifications are described in U.S. Patent Application Publication No. US 20130058937 A1 and in the paragraphs that follow.

The site of most extensive protein-protein interaction between the two subunits of a human IgG Fc domain is in the CH3 domain of the Fc domain. Thus, in one embodiment said modification is in the CH3 domain of the Fc domain.

In a specific embodiment said modification is a so-called "knob-into-hole" modification, comprising a "knob" modification in one of the two subunits of the Fc domain and a "hole" modification in the other one of the two subunits of the Fc domain.

The knob-into-hole technology is described e.g. in U.S. Pat. Nos. 5,731,168; 7,695,936; Ridgway et al., Prot Eng 9, 617-621 (1996) and Carter, J Immunol Meth 248, 7-15 (2001). Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine).

Accordingly, in a particular embodiment, in the CH3 domain of the first Fc domain subunit of an Fc domain an amino acid residue is replaced with an amino acid residue having a larger side chain volume, thereby generating a protuberance within the CH3 domain of the first subunit which is positionable in a cavity within the CH3 domain of the second subunit, and in the CH3 domain of the second Fc domain subunit an amino acid residue is replaced with an amino acid residue having a smaller side chain volume, thereby generating a cavity within the CH3 domain of the second subunit within which the protuberance within the CH3 domain of the first subunit is positionable.

The protuberance and cavity can be made by altering the nucleic acid encoding the polypeptides, e.g. by site-specific mutagenesis, or by peptide synthesis.

In a specific embodiment, in the CH3 domain of the first subunit of the Fc domain the threonine residue at position 366 is replaced with a tryptophan residue (T366W), and in the CH3 domain of the second subunit of the Fc domain the tyrosine residue at position 407 is replaced with a valine residue (Y407V). In one embodiment, in the second subunit of the Fc domain additionally the threonine residue at position 366 is replaced with a serine residue (T366S) and the leucine residue at position 368 is replaced with an alanine residue (L368A). In yet a further embodiment, in the first subunit of the Fc domain additionally the serine residue at position 354 is replaced with a cysteine residue (S354C), and in the second subunit of the Fc domain additionally the tyrosine residue at position 349 is replaced by a cysteine residue (Y349C). Introduction of these two cysteine residues results in formation of a disulfide bridge between the two subunits of the Fc domain, further stabilizing the dimer (Carter, J Immunol Methods 248, 7-15 (2001)).

In an alternative embodiment a modification promoting association of the first and the second subunit of the Fc domain comprises a modification mediating electrostatic steering effects, e.g. as described in PCT publication WO 2009/089004. Generally, this method involves replacement of one or more amino acid residues at the interface of the two Fc domain subunits by charged amino acid residues so that homodimer formation becomes electrostatically unfavorable but heterodimerization electrostatically favorable.

Illustrative examples include but are not limited to, for example, US Patent Application 20030078385 (Arathoon et al.—Genentech; describing knob into holes); WO2007147901 (Kjærgaard et al.—Novo Nordisk: describing ionic interactions); WO 2009089004 (Kannan et al.—Amgen: describing electrostatic steering effects); U.S. Provisional Patent Application 61/243,105 (Christensen et al.—Genentech; describing coiled coils).

In particular embodiments, domains 1 and 2 of a tetrahedral antibody of the invention, or domains 1, 2 and 3 of an octahedral antibody of the invention, are two or three distinct heterodimeric Fc domains comprising distinct sets of modifications promoting intra-heterodimerization of their respective Fc domain subunits. Illustrative examples of distinct sets of mutations in the antibody heavy chain constant region that can be used to promote the preferential assembly of distinct Fc heterodimers include but are not limited to, for example, U.S. Ser. Nos. 11/533,709, 13/494,870, 12/875,015, 13/289,934, 14/773,418, 12/811,207, 13/866,756, 14/647,480, and 14/830,336. For example, mutations can be made in the CH3 domain based on human IgG1 and incorporating distinct pairs of amino acid substitutions within a first polypeptide and a second polypeptide that allow these two chains to selectively heterodimerize with each other. The positions of amino acid substitutions illustrated below are all numbered according to the EU index as in Kabat.

For example, one or more mutations can be incorporated into the constant region as compared to human IgG1 constant region, for example at Q347, Y349, L351, S354, E356, E357, K360, Q362, S364, T366, L368, K370, N390, K392, T394, D399, S400, D401, F405, Y407, K409, T411 and/or K439. Exemplary substitutions include, for example, Q347E, Q347R, Y349S, Y349K, Y349T, Y349D, Y349E, Y349C, T350V, L351K, L351D, L351Y, S354C, E356K, E357Q, E357L, E357W, K360E, K360W, Q362E, S364K, S364E, S364H, S364D, T366V, T366I, T366L, T366M, T366K, T366W, T366S, L368E, L368A, L368D, K370S, N390D, N390E, K392L, K392M, K392V, K392F, K392D, K392E, T394F, T394W, D399R, D399K, D399V, S400K, S400R, D401K, F405A, F405T, Y407A, Y407I, Y407V, K409F, K409W, K409D, T411D, T411E, K439D, and K439E.

Alternatively, amino acid substitutions could be selected from the following sets of substitutions shown in the tables below:

TABLE C-1

| Sets of substitutions | | |
|---|---|---|
| | First Polypeptide | Second Polypeptide |
| Set 1 | S364E/F405A | Y349K/T394F |
| Set 2 | S364H/D401K | Y349T/T411E |
| Set 3 | S364H/T394F | Y349T/F405A |
| Set 4 | S364E/T394F | Y349K/F405A |
| Set 5 | S364E/T411E | Y349K/D401K |
| Set 6 | S364D/T394F | Y349K/F405A |
| Set 7 | S364H/F405A | Y349T/T394F |
| Set 8 | S364K/E357Q | L368D/K370S |
| Set 9 | L368D/K370S | S364K |
| Set 10 | L368E/K370S | S364K |
| Set 11 | K360E/Q362E | D401K |
| Set 12 | L368D/K370S | S364K/E357L |
| Set 13 | K370S | S364K/E357Q |
| Set 14 | F405L | K409R |
| Set 15 | K409R | F405L |

TABLE C-2

| Sets of substitutions | | |
|---|---|---|
| | First Polypeptide | Second Polypeptide |
| Set 1 | K409W | D399V/F405T |
| Set 2 | Y349S | E357W |
| Set 3 | K360E | Q347R |
| Set 4 | K360E/K409W | Q347R/D399V/F405T |
| Set 5 | Q347E/K360E/K409W | Q347R/D399V/F405T |
| Set 6 | Y349S/K409W | E357W/D399V/F405T |

TABLE C-3

| Sets of substitutions | | |
|---|---|---|
| | First Polypeptide | Second Polypeptide |
| Set 1 | T366K/L351K | L351D/L368E |
| Set 2 | T366K/L351K | L351D/Y349E |
| Set 3 | T366K/L351K | L351D/Y349D |
| Set 4 | T366K/L351K | L351D/Y349E/L368E |
| Set 5 | T366K/L351K | L351D/Y349D/L368E |
| Set 6 | E356K/D399K | K392D/K409D |

TABLE C-4

| Sets of substitutions | |
|---|---|
| First Polypeptide | Second Polypeptide |
| L351Y, D399R, D399K, S400K, S400R, Y407A, Y407I, Y407V | T366V, T366I, T366L, T366M, N390D, N390E, K392L, K392M, K392V, K392F K392D, K392E, K409F, K409W, T411D and T411E |

Alternatively, at least one amino acid substitutions could be selected from the following set of substitutions in Table C-5, where the position(s) indicated in the First Polypeptide column is replaced by any known negatively-charged amino acid, and the position(s) indicated in the Second Polypeptide Column is replaced by any known positively-charged amino acid.

TABLE C-5

| Sets of substitutions | |
|---|---|
| First Polypeptide | Second Polypeptide |
| K392, K370, K409, orK439 | D399, E356, or E357 |

Alternatively, at least one amino acid substitutions could be selected from the following set of in Table C-6, where the position(s) indicated in the First Polypeptide column is replaced by any known positively-charged amino acid, and the position(s) indicated in the Second Polypeptide Column is replaced by any known negatively-charged amino acid.

TABLE C-6

| Sets of substitutions | |
|---|---|
| First Polypeptide | Second Polypeptide |
| D399, E356, or E357 | K409, K439, K370, or K392 |

Alternatively, amino acid substitutions could be selected from the following set of in Table C-7.

TABLE C-7

| Sets of substitutions | |
|---|---|
| First Polypeptide | Second Polypeptide |
| T350V, L351Y, F405A, and Y407V | T350V, T366L, K392L, and T394W |

Alternatively, or in addition, the structural stability of a heteromultimer protein may be increased by introducing S354C on either of the first or second polypeptide chain, and Y349C on the opposing polypeptide chain, which forms an artificial disulfide bridge within the interface of the two polypeptides.

Extra-Homodimerization and Extra-Heterodimerization Between Domain 1 and Domain 2

In an embodiment, homodimerization between domain 1 and domain 2 (i.e. extra-homodimerization) is achieved by use of a first and a second dimerizing polypeptide which homodimerize. One example of a homodimerization domain is the ACE2 collectrin-like domain (CLD).

In an embodiment, heterodimerization between domain 1 and domain 2 (i.e. extra-heterodimerization) is achieved by use of a first and a second dimerizing polypeptide which favor the formation of a heterodimer over a homodimer. Any non-immunoglobulin dimerization polypeptide having a strong preference for forming heterodimers over homodimers is within the scope of the invention.

Dimerizing Polypeptides

Leucine Zipper Domains

Leucine zippers are well known in the art (see Hakoshima; Encyclopedia of Life Sciences; 2005, for example). The leucine zipper is a super-secondary structure that may function as a dimerization domain. Its presence generates adhesion forces in parallel alpha helices. A single leucine zipper consists of multiple leucine residues at approximately 7-residue intervals, which forms an amphipathic alpha helix with a hydrophobic region running along one side. This hydrophobic region provides an area for dimerization, allowing the motifs to "zip" together. Leucine zippers are typically 20 to 40 amino acids in length, for example approximately 30 amino acids. See also Pack, P. & Plueckthun, A., Biochemistry 31, 1579-1584 (1992).

Leucine zipper domains may be such that the formation of heterodimers is more favorable than the formation of homodimers of the helices. Leucine zippers may be synthetic or naturally occurring. Synthetic leucines can be designed to have a much higher binding affinity. Alternatively, naturally occurring leucine zippers or leucine zippers with a similar binding affinity may be used. Leucine zippers from the c-jun and c-fos protein are an example of leucine zippers. Other leucine zippers include those from the myc and max proteins (Amati, B., S. Dalton, et al. (1992). Nature 359 (6394): 423-6.). Other leucine zippers with suitable properties may be designed, for example as described in O'Shea, E. K., Lumb, K. J. and Kim, P. S. (1993) Curr. Biol. 3:658-667. See also O'Shea, E. K., Rutkowski, R., et al. (1989) Science 245:646-648 and O'Shea, E. K., R. Rutkowski, et al. (1992). Cell 68 (4): 699-708 describe leucine zippers from c-jun (αchain) and c-fos (βchain).

As discussed in U.S. Patent Application Publication No. US20020119149 A1 (Jakobsen), leucine zippers can be designed and engineered by those skilled in the art to form homodimers, heterodimers or trimeric complexes. See Lumb, K. J. and P. S. Kim (1995). Biochemistry 34 (27): 8642-8; Nautiyal, S., D. N. Woolfson, et al. (1995). Biochemistry 34 (37): 11645-51; Boice, J. A., G. R. Dieckmann, et al. (1996). Biochemistry 35 (46): 14480-5; and Chao, H., M. E. Houston, Jr., et al. (1996). Biochemistry 35 (37): 12175-85.

Collectrin-Like Domains

Full-length ACE2 consists of an N-terminal Peptidase Domain (PD) and a C-terminal collectrin-like domain (CLD) that ends with a single transmembrane helix and a ~40-residue intracellular segment. The CLD (residues 616 to 768 of ACE2), consists of a small extracellular domain, a long linker, and the single transmembrane (TM) helix. The CLD comprises the "neck domain" of ACE2 (residues 616 to 726), which is the primary mediator of dimerization of ACE2. (Yan et al., Science 367, 1444-1448 (2020))

Collectrin Domains

Collectrin is a homolog of ACE2 and is a transmembrane glycoprotein specifically expressed in collecting tubules of the kidney. Based on its homology to the ACE2 CLD, it is expected that Collectrin domains may be capable of forming homodimers (Zhang et al. J Biol. Chem. Vol. 276, No. 20, Issue of May 18, pp. 17132-17139, 2001)

Extra-Heterodimerization

An embodiment of the invention is a tetrahedral antibody or tetrahedral molecule comprising a heterodimeric dimerizing polypeptide. It is desirable to create versions of the dimerizing polypeptides of the collectrin-like domain and collectrin that form heterodimers but not homodimers. One strategy for engineering heterodimers from homodimers is the introduction of charged amino acids into the first dimerizing polypeptide that disrupt homodimerization concomitantly with the introduction of charge-complementary amino acids into the second dimerizing polypeptide at spatially proximal positions which can form salt bridges with the first dimerizing polypeptide that promote heterodimerization. Preferred charged-complementary amino acids are those having negatively and/or positively charged atoms on their side chains at physiological pH, e.g., glutamic acid and aspartic acid, and lysine, arginine, and histidine, respectively.

Dimerization of the ACE2 protein is mainly mediated by the collectrin-like domain (CLD) (Yan et al., 2020, Science, 367 (6485): 1444-1448). The homodimer interface formed by the first and second CLD dimerizing polypeptides, referred to herein as CLD-A and CLD-B, is mediated by extensive polar interactions mapped to the second (residues 636 to 658) and fourth (residues 708 to 717) helices of each CLD dimerizing polypeptide (all positions are based on the human ACE2 sequence shown in SEQ ID NO: 2040). For example, Arg652 and Arg710 in CLD-A are respectively hydrogen-bonded (H-bonded) to Asn638' and Glu639' in CLD-B, which also interact with Gln653 in CLD-A, as does Asn636' in CLD-B. Ser709 and Asp713 from CLD-A are hydrogen-bonded to Arg716' in CLD-B. This extensive network of polar interactions indicates stable dimer formation. Additionally, Arg652 and Arg710 in CLD-A form cation-π interactions with Tyr641' and Tyr633' in CLD-B, while Arg652' and Arg710' in CLD-B form cation-π interactions with Tyr641 and Tyr633 in CLD-A. Thus, Arg652 and Arg710 play a critical role in the homodimer interface both via extensive hydrogen bonding and the formation of four cross-strand cation-π interactions in concert with Tyr641 and Tyr633, thus offering a starting point for the creation of CLD dimerizing polypeptides that heterodimerize but do not homodimerize.

Additionally, the aforementioned arginine and tyrosine residues are conserved at essentially the same positions in human collectrin, specifically Arg59, Arg111, Tyr48, and Tyr40, suggesting they play an analogous role in collectrin dimerization and would benefit from the same charge pair substitutions in promoting the selective formation of heterodimers over homodimers (all positions are based on the human collectrin/TMEM27 sequence shown in SEQ ID NO: 3078).

Substitutions throughout the CLD and collectrin dimerizing polypeptides are readily screened for their ability to disrupt homodimer formation and promote heterodimer formation as neither dimerizing polypeptide is readily secreted as a discrete monomer into the culture supernatant. Preferred positions for substitutions that disrupt homodimer formation and promote heterodimer formation are in the second and fourth helices of the CLD and collectrin. Particularly preferred positions for substitutions that disrupt homodimer formation and promote heterodimer formation in the CLD dimerizing polypeptide are Arg652, Arg710, Tyr641, Tyr633, Asn638, Glu639, Gln653, and Asn636, Ser709, Asp713, and Arg716. Particularly preferred positions for substitutions that disrupt homodimer formation and promote heterodimer formation in the collectrin dimerizing polypeptide are Arg59, Arg111, Tyr48, and Tyr40.

Preferred amino acid substitutions at Tyr641 and Tyr633 (CLD) and Tyr48 and Tyr40 (collectrin) for disrupting homodimer formation are the positively charged amino acids lysine, arginine and histidine. Preferred amino acid substitutions at Arg652 and Arg710 (collectrin-like domain) and Arg59 and Arg111 (collectrin) for disrupting homodimer formation are the negatively charged amino acids glutamic acid and aspartic acid, which are likely to form much a weaker anion-π interaction with tyrosine given their shorter side-chain length, as well as the positively charged amino acid lysine. The utility of lysine substitution for arginine in disrupting CLD homodimer formation is indicated by the absence of substitution of lysine for Arg652 and Arg710 in an extensive evolutionary search; additionally, lysine forms significantly fewer stable cation-π interactions in proteins than arginine and lacks the hydrogen-bounding characteristics of arginine (Gallivan et al., 1999, Proc. Natl. Acad. Sci., 96 (17): 9459-9464; Kumar et al., 2018, Chem. Sci., 9 (10): 2655-2665).

Preferred charge pair substitutions for promoting heterodimer over homodimer formation include lysine-glutamic acid, lysine-aspartic acid, arginine-glutamic acid, and arginine-aspartic acid. The aforementioned charge pairs may be used in either orientation with respect to the first and second dimerizing polypeptides.

Preferred dimerizing polypeptides of the invention are collectrin or collectrin-like domains, or portions, derivatives and/or hybrids thereof. Preferred dimerizing polypeptides include those described in SEQ ID NOs: 782-786.

Figure 29A:
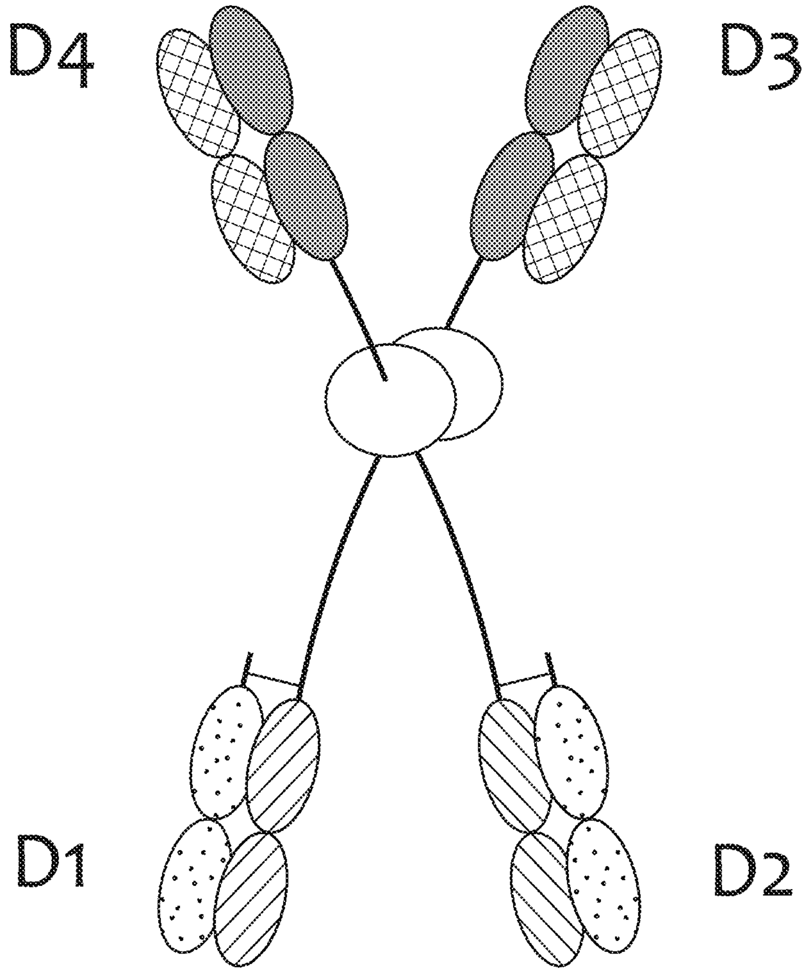
FIG. 29A: Tetrahedral antibody comprising a first and second dimerizing polypeptide that form a homodimeric non-covalent linkage, wherein each of D1 and D2 is a heterodimeric Fc domain, and each of D3 and D4 is a Fab domain that specifically binds to a first target.
Figure 29B:
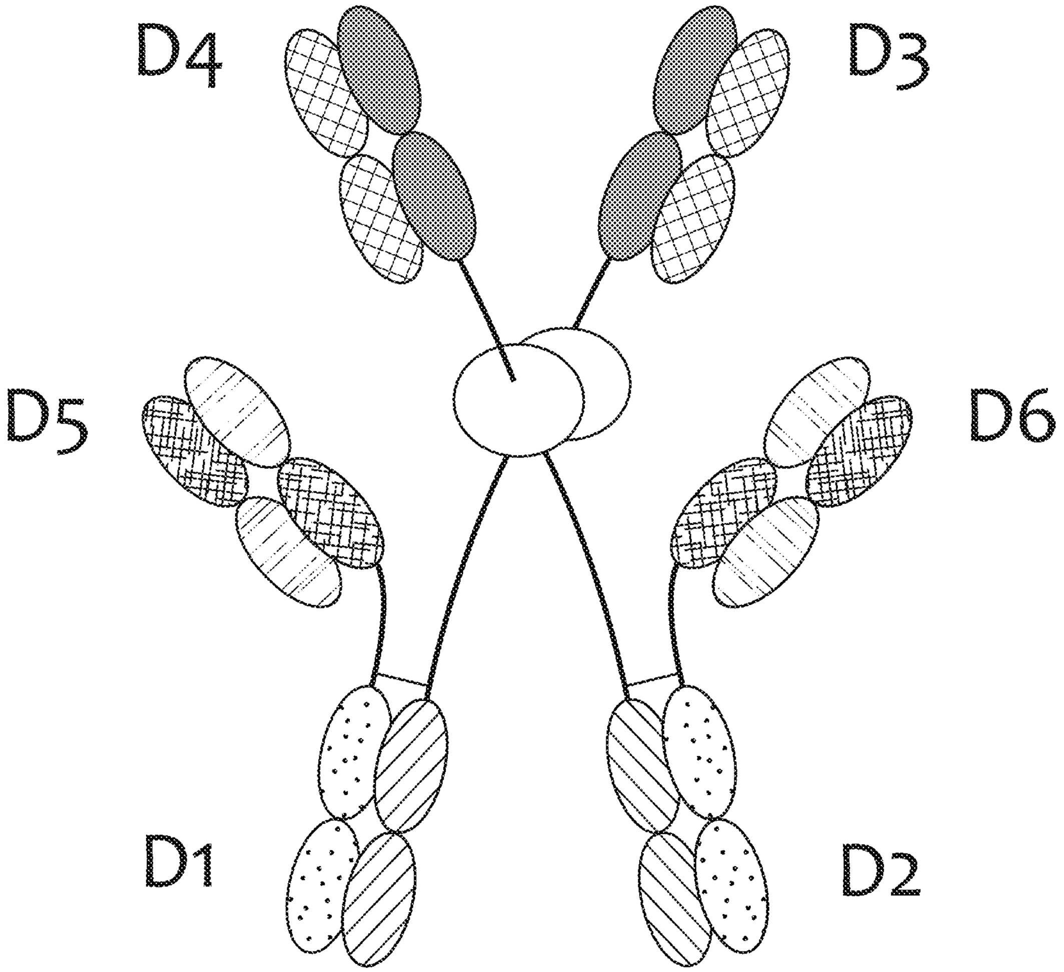
FIG. 29B: Tetrahedral antibody comprising a first and second dimerizing polypeptide that form a homodimeric non-covalent linkage, wherein each of D1 and D2 is a heterodimeric Fc domain, each of D3 and D4 is a Fab domain that specifically binds to a first target, and each of D5 and D6 is a variable region exchanged Fab domain that specifically binds to a second target.
Figure 29C:
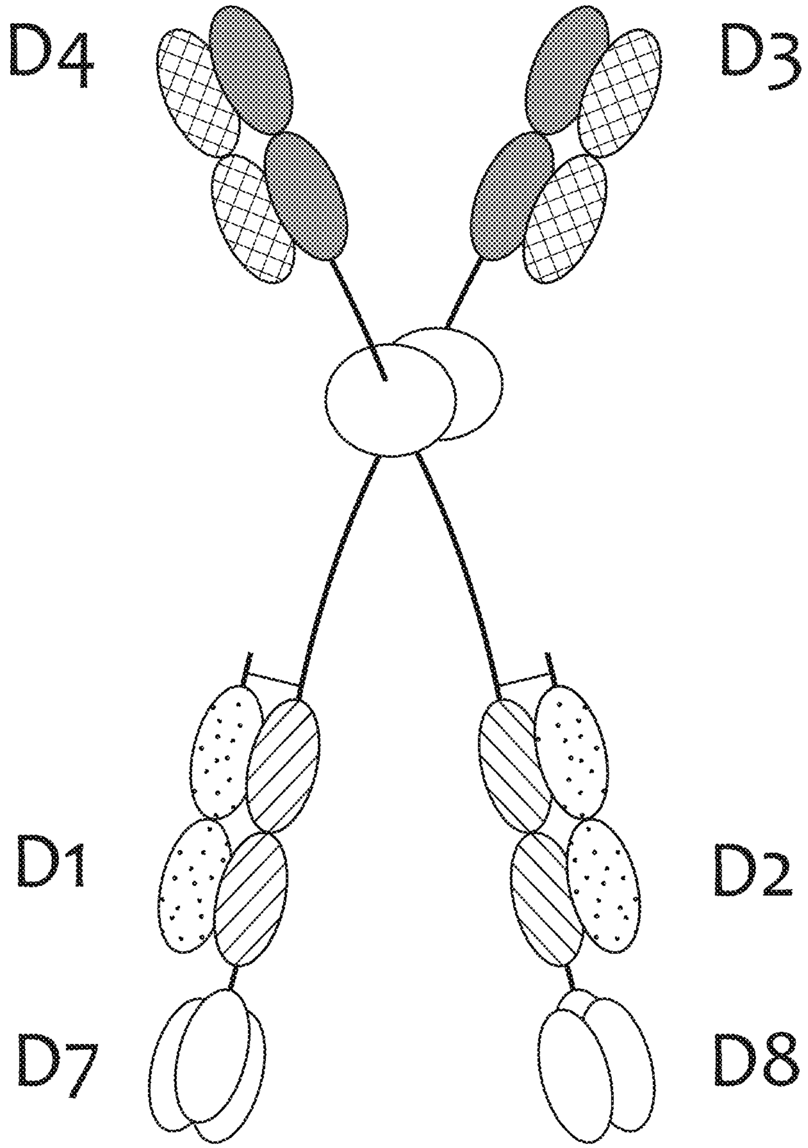
FIG. 29C: Tetrahedral antibody comprising a first and second dimerizing polypeptide that form a homodimeric non-covalent linkage, wherein each of D1 and D2 is a heterodimeric Fc domain, each of D3 and D4 is a Fab domain that specifically binds to a first target, and each of D7 and D8 is a domain that specifically binds to a second target. D7 and D8 are each depicted as a single-chain TNFSF fusion polypeptide but may be any domain.
Figure 29D:
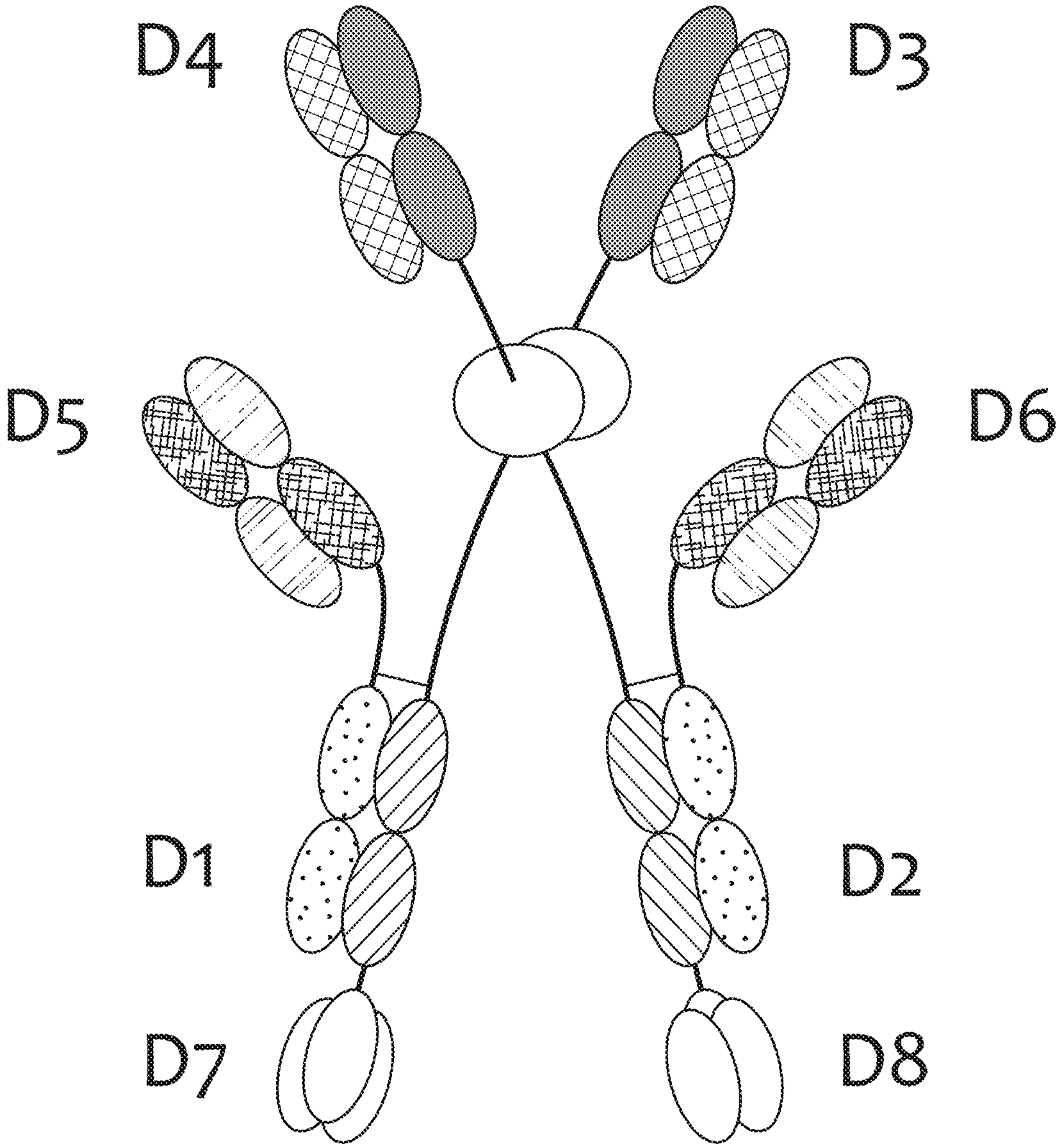
FIG. 29D: Tetrahedral antibody comprising a first and second dimerizing polypeptide that form a homodimeric non-covalent linkage, wherein each of D1 and D2 is a heterodimeric Fc domain, each of D3 and D4 is a Fab domain that specifically binds to a first target, each of D5 and D6 is a variable region exchanged Fab domain that specifically binds to a second target, and each of D7 and D8 is a domain that specifically binds to a third target. D7 and D8 are depicted as a single-chain TNFSF fusion polypeptide but may be any domain.
Figure 30A:
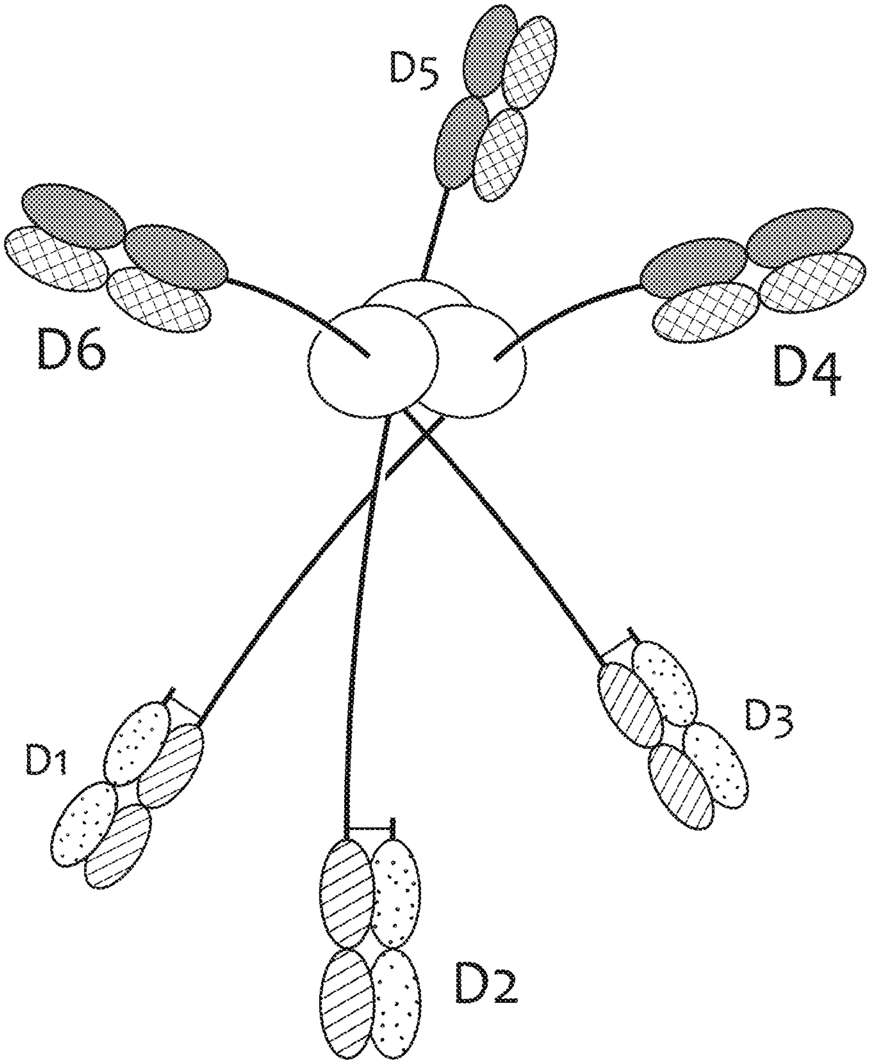
FIG. 30A: Octahedral antibody comprising a first, second and third trimerizing polypeptide that form a homotrimeric non-covalent linkage, wherein each of D1, D2 and D3 is a heterodimeric Fc domain, and each of D4, D5 and D5 is a Fab domain that specifically binds to a first target.
Figure 30B:
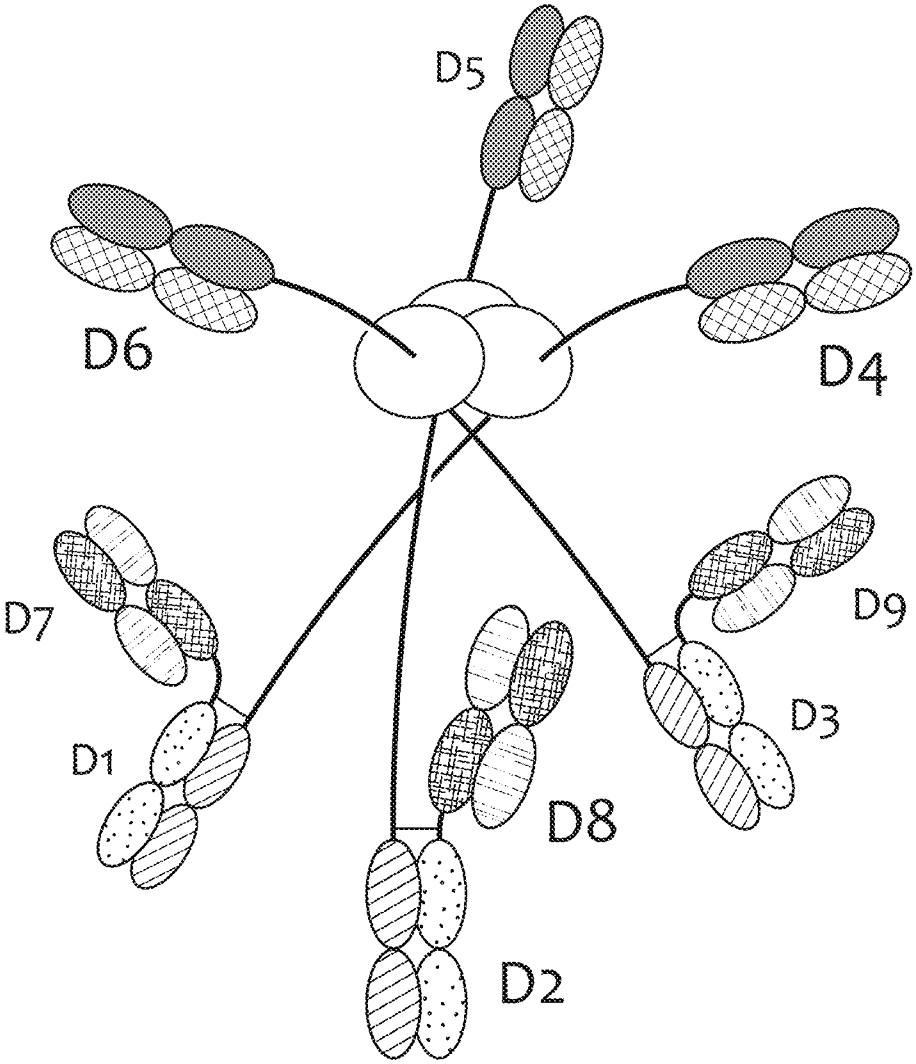
FIG. 30B: Octahedral antibody comprising a first, second and third trimerizing polypeptide that form a homotrimeric non-covalent linkage, wherein each of D1, D2 and D3 is a heterodimeric Fc domain, each of D4, D5 and D6 is a Fab domain that specifically binds to a first target, and each of D7, D8 and D9 is a variable region exchanged Fab domain that specifically binds to a second target.
Figure 30C:
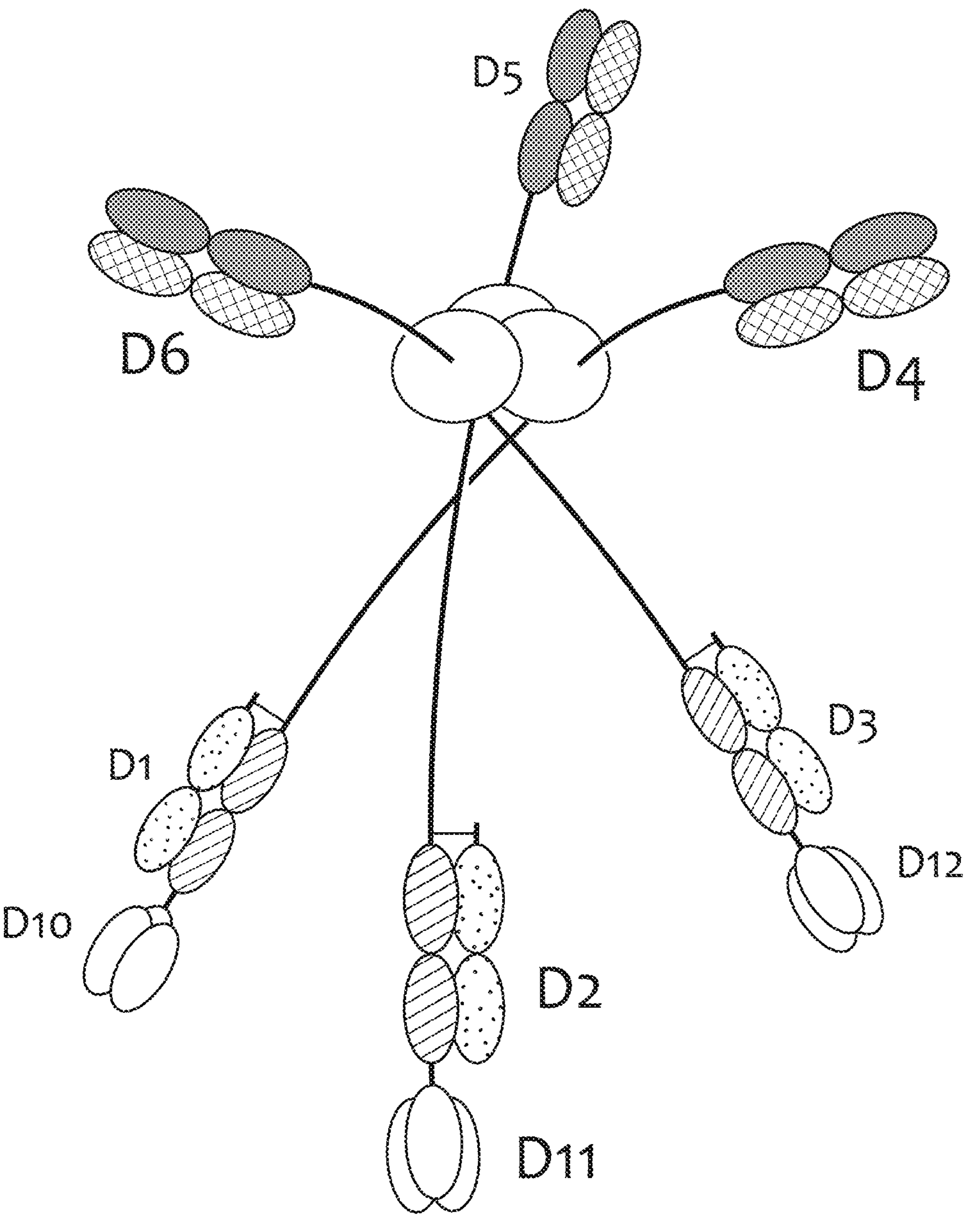
FIG. 30C: Octahedral antibody comprising a first, second and third trimerizing polypeptide that form a homotrimeric non-covalent linkage, wherein each of D1, D2 and D3 is a heterodimeric Fc domain, each of D4, D5 and D6 is a Fab domain that specifically binds to a first target, and each of D10, D11 and D12 specifically binds to a second target. D10, D11 and D12 each are depicted as a single-chain TNFSF fusion polypeptide but may be any domain.
Figure 30D:
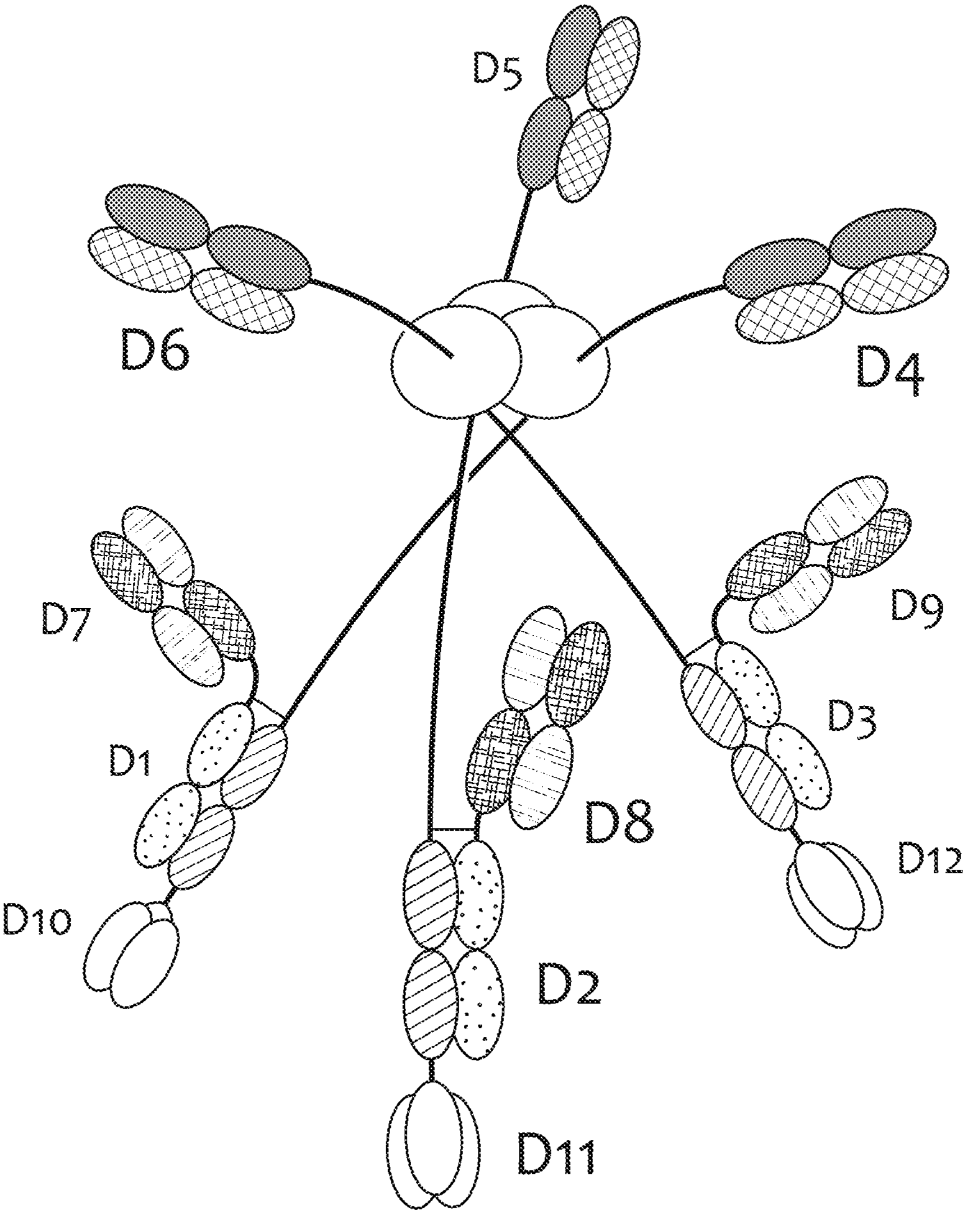
FIG. 30D: Octahedral antibody comprising a first, second and third trimerizing polypeptide that form a homotrimeric non-covalent linkage, wherein each of D1, D2 and D3 is a heterodimeric Fc domain, each of D4, D5 and D6 is a Fab domain that specifically binds to a first target, each of D7, D8 and D9 is a variable region exchanged Fab domain that specifically binds to a second target and each of D10, D11 and D12 specifically binds to a third target. D10, D11 and D12 are each depicted as a single-chain TNFSF fusion polypeptide but may be any domain.

To identify mutations that disrupt homodimerization of the collectrin-like domain, a series of variants are prepared in which each of amino acid residues Tyr633, Tyr641, Arg652, and Arg710 is independently substituted with lysine and glutamic acid. Each of the resulting variants is expressed as tetrahedral antibody of three different chains, an H1 chain, L1 chain, and Fc chain, as shown in FIG. 29A. Domains D1 and D2 are heterodimeric Fc domains formed by the H1 and Fc chains, and domains D3 and D4 are anti-CD19 FMC63 Fabs formed by the H1 and L1 chains. Table 82 summarizes the SEQ IDs of the H1, L1, and Fc chains used for the expression of each variant. Table 83 summarizes the amino acid substitutions at Tyr633, Tyr641, Arg652, and Arg710 for each variant. Table 83 also summarizes the predicted interaction between the first and second dimerizing polypeptides for each of the variants with respect to the cognate Arg710-Tyr633 and Arg652-Tyr641 pairs of the parent CLD dimerizing polypeptides from which they are derived.

Each tetrahedral antibody is evaluated for its ability to be expressed and secreted in CHO cells. Variants that are not expressed and secreted as homodimers are further evaluated for their ability to expressed and secreted as heterodimers via their co-expression together with other variants that are not expressed and secreted as homodimers.

Disulfide Linkages Between Dimerizing Polypeptides

Additionally, such charge pairs may be used together with one or more disulfide linkages between the first and second dimerizing polypeptides to further promote the formation and stability of the resulting heterodimers. Preferred disulfides are those engineered at the CLD-A/CLD-B interface, particularly at the second and fourth helices of the collectrin-like domain and the corresponding region in collectrin. Other preferred disulfides include immunoglobulin hinge regions appended at the N-terminus and/or C-terminus of the collectrin-like domain and collectrin. Such hinge regions may be appended directly or via peptide linkers.

IgG1, IgG2, IgG3, and IgG4 hinge regions or portions thereof comprising at least one cysteine available for forming a disulfide bond may be used to form the one or more disulfide linkages between the first and second dimerizing polypeptides as discussed above.

Trimerizing Domains

TNF Ligand Superfamily Members

Members of the TNF ligand superfamily may be used as trimerizing domains of the inventions. They are described in Locksley et al., Cell. 2001 Feb. 23; 104 (4): 487-501 and the table reproduced below.

TABLE B-2

| Members of the TNF Superfamily | | | | | |
|---|---|---|---|---|---|
| Ligand | Standardized | Other Names | Accession | Human Chromosome | Mouse Chromosome |
| EDA | | EDA1 | NM_ 001399 | Xq12-q13.1 | X, 37.0 cM |
| CD40L | TNFSF5 | IMD3, HIGM1, TRAP, CD 154, gp39 | X67878 | Xq26 | X, 18.0 cM |
| FasL | TNFSF6 | APT1LG1 | U11821 | 1q23 | 1, 85.0 cM |
| OX40L | TNFSF4 | gp34 TXGP1 | D90224 | 1q25 | 1, 84.9 cM |
| AITRL | TNFSF18 | TL6, hGITRL | AF125303 | 1q23 | |
| CD30L | TNFSF8 | | L09753 | 9q33 | 4, 32.2 cM |
| VEGI | TNFSF15 | TL1 | AF039390 | | |
| LIGHT | TNFSF14 | LT_, HVEM-L | AF036581 | 19 (probable) | 17 |
| 4-1BBL | TNFSF9 | | U03398 | 19p13.3 | 17 |
| CD27L | TNFSF7 | CD70 | L08096 | 19p13 | 17, 20.0 cM |
| LTα | TNFSF1 | TNFB, LT | X01393 | 6p21.3 | 17, 19.06 cM |
| TNF | TNFSF2 | tumor necrosis factor; cachectin, TNFA, DIF | X01394 | 6p21.3 | 17, 19.06 |
| LTβ | TNFSF3 | TNFC, p33 | L11015 | 6p21.3 | 17, 19.061 |
| TWEAK | TNFSF12 | DR3L APO3L | AF030099 | 17p13 | 11? |
| APRIL | TNFSF13 | | NM_ 003808 | 17p13.1 | 11? |
| BLYS | TNFSF13B | BAFF, THANK, TALL1 | AF132600 | 13q32-34 | |
| RANKL | TNFSF11 | TRANCE, OPGL, ODF | AF013171 | 13q14 | 14, 45.0 |
| TRAIL | TNFSF10 | Apo-2L TL2 | U37518 | 3q26 | |

Suitable examples of the trimerizing polypeptides of the invention are the complete extracellular regions or portions thereof of TNFSF1 (UniProtKB TNFB_HUMAN, GenBank Accession No. P01374), TNFSF2 (UniProtKB TNFA_HUMAN, GenBank Accession No. P01375), TNFSF3 (UniProtKB TNFC_HUMAN, GenBank Accession No. Q06643), TNFSF4 (UniProtKB TNFL4_HUMAN, GenBank Accession No. P23510), TNFSF5 (UniProtKB CD40L_HUMAN, GenBank Accession No. P29965), TNFSF6 (UniProtKB TNFL6_HUMAN, GenBank Accession No. P48023), TNFSF7 (UniProtKB CD70_HUMAN, GenBank Accession No. P32970), TNFSF8 (UniProtKB TNFL8_HUMAN, GenBank Accession No. P32971), TNFSF9 (UniProtKB TNFL9_HUMAN, GenBank Accession No. P41273), TNFSF10 (UniProtKB TNF10_HUMAN, GenBank Accession No. P50591), TNFSF11 (UniProtKB TNF11_HUMAN, GenBank Accession No. 014788), TNFSF12 (UniProtKB TNF12_HUMAN, GenBank Accession No. O43508), TNFSF13 (UniProtKB TNF13_HUMAN, GenBank Accession No. O75888), TNFSF13B (UniProtKB TN13B_HUMAN, GenBank Accession No. Q9Y275), TNFSF14 (UniProtKB TNF14_HUMAN; GenBank Accession No. 043557), TNFSF15 (UniProtKB TNF15_HUMAN, GenBank Accession No. 095150), and TNFSF18 (UniProtKB TNF18_HUMAN; GenBank Accession No. Q9UNG2).

Preferred trimerizing polypeptides are shown in SEQ ID NOs: 787-790 (TNFSF1), SEQ ID NOs: 791-792 (TNFSF2), SEQ ID NOs: 793-795 (TNFSF3), SEQ ID NOs: 796-798 (TNFSF4), SEQ ID NOs: 799-802 (TNFSF5), SEQ ID NOs: 803-806, SEQ ID NOs: 807-809 (TNFSF7), SEQ ID NOs: 810-813 (TNFSF8), SEQ ID NOs: 814-816 (TNFSF9), SEQ ID NOs: 817-820 (TNFSF10), SEQ ID NOs: 821-822 (TNFSF11), SEQ ID NOs: 823-827 (TNFSF12), SEQ ID NOs: 828-831 (TNFSF13), SEQ ID NOs: 832-833 (TNFSF13B), SEQ ID NOs: 834-837 (TNFSF14), SEQ ID NOs: 838-841 (TNFSF15), and SEQ ID NOs: 842-843 (TNFSF18).

Kits

Another aspect of the present invention provides kits comprising the compounds disclosed herein and the pharmaceutical compositions comprising these compounds. A kit may include, in addition to the compound or pharmaceutical composition, diagnostic or therapeutic agents. A kit may also include instructions for use in a diagnostic or therapeutic method. In a diagnostic embodiment, the kit includes the compound or a pharmaceutical composition thereof and a diagnostic agent. In a therapeutic embodiment, the kit includes the antibody or a pharmaceutical composition thereof and one or more therapeutic agents, such as an additional antineoplastic agent, anti-tumor agent or chemotherapeutic agent.

General Techniques

The description below relates primarily to production of stretches of consecutive amino acids or polypeptides of interest by culturing cells transformed or transfected with a vector containing an encoding nucleic acid. It is, of course, contemplated that alternative methods, which are well known in the art, may be employed. For instance, the amino acid sequence, or portions thereof, may be produced by direct peptide synthesis using solid-phase techniques (see, e.g., Stewart et al., Solid-Phase Peptide Synthesis, W.H. Freeman Co., San Francisco, Calif. (1969); Merrifield, J. Am. Chem. Soc., 85:2149-2154 (1963)). In vitro protein synthesis may be performed using manual techniques or by automation. Automated synthesis may be accomplished, for instance, using an Applied Biosystems Peptide Synthesizer (Foster City, Calif.) using manufacturer's instructions. Various portions of the stretches of consecutive amino acids or polypeptides of interest may be chemically synthesized separately and combined using chemical or enzymatic methods to produce the full-length stretches of consecutive amino acids or polypeptides of interest.

Selection and Transformation of Host Cells

Host cells are transfected or transformed with expression or cloning vectors described herein for production and cultured in conventional nutrient media modified as appropriate for inducing promoters, selecting transformants, or amplifying the genes encoding the desired sequences. The culture conditions, such as media, temperature, pH and the like, can be selected by the skilled artisan without undue experimentation. In general, principles, protocols, and practical techniques for maximizing the productivity of cell cultures can be found in Mammalian Cell Biotechnology: a Practical Approach, M. Butler, ed. (IRL Press, 1991) and Sambrook et al., supra.

Methods of eukaryotic cell transfection and prokaryotic cell transformation are known to the ordinarily skilled artisan, for example, $CaCl_2$), $CaPO_4$, liposome-mediated and electroporation. Depending on the host cell used, transformation is performed using standard techniques appropriate to such cells. The calcium treatment employing calcium chloride, as described in Sambrook et al., supra, or electroporation is generally used for prokaryotes. Infection with *Agrobacterium tumefaciens* is used for transformation of certain plant cells, as described by Shaw et al., Gene, 23:315 (1983) and WO 89/05859 published Jun. 29, 1989. For mammalian cells without such cell walls, the calcium phosphate precipitation method of Graham and van der Eb, Virology, 52:456-457 (1978) can be employed. General aspects of mammalian cell host system transfections have been described in U.S. Pat. No. 4,399,216. Transformations into yeast are typically carried out according to the method of Van Solingen et al., J. Bact., 130: 946 (1977) and Hsiao et al., Proc. Natl. Acad. Sci. (USA), 76:3829 (1979). However, other methods for introducing DNA into cells, such as by nuclear microinjection, electroporation, bacterial protoplast fusion with intact cells, or polycations, e.g., polybrene, polyornithine, may also be used. For various techniques for transforming mammalian cells, see Keown et al., Methods in Enzymology, 185:527-537 (1990) and Mansour et al., Nature, 336:348-352 (1988).

Suitable host cells for cloning or expressing the DNA in the vectors herein include prokaryote, yeast, or higher eukaryote cells. Suitable prokaryotes include but are not limited to eubacteria, such as Gram-negative or Gram-positive organisms, for example, Enterobacteriaceae such as *E. coli*. Various *E. coli* strains are publicly available, such as *E. coli* K12 strain MM294 (ATCC 31,446); *E. coli* X1776 (ATCC 31,537); *E. coli* strain W3110 (ATCC 27,325) and K5772 (ATCC 53,635). Other suitable prokaryotic host cells include Enterobacteriaceae such as *Escherichia*, e.g., *E. coli, Enterobacter, Erwinia, Klebsiella, Proteus, Salmonella*, e.g., *Salmonella typhimurium, Serratia*, e.g., *Serratia marcescans*, and *Shigella*, as well as Bacilli such as *B. subtilis* and *B. licheniformis* (e.g., *B. licheniformis* 41P disclosed in DD 266,710 published Apr. 12, 1989), *Pseudomonas* such as *P. aeruginosa*, and *Streptomyces*. These examples are illustrative rather than limiting. Strain W3110 is one particularly preferred host or parent host because it is a common host strain for recombinant DNA product fermentations. Preferably, the host cell secretes minimal amounts of proteolytic enzymes. For example, strain W3110 may be modified to effect a genetic mutation in the genes encoding proteins endogenous to the host, with examples of such hosts including *E. coli* W3110 strain 1A2, which has the complete genotype tonA; *E. coli* W3110 strain 9E4, which has the complete genotype tonA ptr3; *E. coli* W3110 strain $27C_7$ (ATCC 55,244), which has the complete genotype tonAptr3phoA E15 (argF-lac) 169 degP ompT $kan^r$; *E. coli* W3110 strain 37D6, which has the complete genotype tonA ptr3 phoA E15 (argF-lac) 169 degP ompT rbs7 ilvG $kan^r$, *E. coli* W3110 strain 40B4, which is strain 37D6 with a non-kanamycin resistant degP deletion mutation; and an *E. coli* strain having mutant periplasmic protease disclosed in U.S. Pat. No. 4,946,783 issued Aug. 7, 1990. Alternatively, in vitro methods of cloning, e.g., PCR or other nucleic acid polymerase reactions, are suitable.

In addition to prokaryotes, eukaryotic microbes such as filamentous fungi or yeast are suitable cloning or expression hosts for encoding vectors. *Saccharomyces cerevisiae* is a commonly used lower eukaryotic host microorganism. Others include *Schizosaccharomyces pombe* (Beach and Nurse, Nature, 290:140 (1981); EP 139,383 published May 2, 1985); *Kluyveromyces* hosts (U.S. Pat. No. 4,943,529; Fleer et al., Bio/Technology, 9:968-975 (1991)) such as, e.g., *K. lactis* (MW98-8C, CBS683, CBS4574; Louvencourt et al., J. Bacteriol., 737 (1983)), *K. fragilis* (ATCC 12,424), *K. bulgaricus* (ATCC 16,045), *K. wickerhamii* (ATCC 24,178), *K. waltii* (ATCC 56,500), *K. drosophilarum* (ATCC 36,906; Van den Berg et al., Bio/Technology, 8:135 (1990)), *K. thermotolerans*, and *K. marxianus; yarrowia* (EP 402,226); *Pichia pastoris* (EP 183,070; Sreekrishna et al., J. Basic Microbiol., 28:265-278 (1988)); *Candida; Trichoderma* reesia (EP 244,234); *Neurospora crassa* (Case et al., Proc. Natl. Acad. Sci. USA, 76:5259-5263 (1979)); *Schwanniomyces* such as *Schwanniomyces occidentalis* (EP 394,538 published Oct. 31, 1990); and filamentous fungi such as, e.g., *Neurospora, Penicillium, Tolypocladium* (WO 91/00357 published Jan. 10, 1991), and *Aspergillus* hosts such as *A. nidulans* (Ballance et al., Biochem. Biophys. Res. Commun., 112:284-289 (1983); Tilburn et al., Gene, 26:205-221 (1983); Yelton et al., Proc. Natl. Acad. Sci. USA, 81:1470-1474 (1984)) and *A. niger* (Kelly and Hynes, EMBO J., 4:475479 (1985)). Methylotropic yeasts are suitable herein and include, but are not limited to, yeast capable of growth on methanol selected from the genera consisting of *Hansenula, Candida, Kloeckera, Pichia, Saccharomyces, Torulopsis*, and *Rhodotorula*. A list of specific species that are exemplary of this class of yeasts may be found in C. Anthony, The Biochemistry of Methylotrophs, 269 (1982).

Suitable host cells for the expression of glycosylated stretches of consecutive amino acids or polypeptides of interest are derived from multicellular organisms. Examples of invertebrate cells include insect cells such as *Drosophila* S2 and *Spodoptera* Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., J. Gen Virol., 36:59 (1977)); Chinese hamster ovary cells/-DHFR (CHO, Urlaub and Chasin, Proc. Natl. Acad. Sci. USA, 77:4216 (1980)); mouse sertoli cells (TM4, Mather, Biol. Reprod., 23:243-251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art.

Selection and Use of a Replicable Vector

The nucleic acid (e.g., cDNA or genomic DNA) encoding the stretch of consecutive amino acids or polypeptides of interest may be inserted into a replicable vector for cloning (amplification of the DNA) or for expression. Various vectors are publicly available. The vector may, for example, be in the form of a plasmid, cosmid, viral particle, or phage. The appropriate nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan.

The stretches of consecutive amino acids or polypeptides of interest may be produced recombinantly not only directly, but also as a fusion polypeptide with a heterologous polypeptide, which may be a signal sequence or other polypeptide having a specific cleavage site at the N-terminus of the mature protein or polypeptide. In general, the signal sequence may be a component of the vector, or it may be a part of the encoding DNA that is inserted into the vector. The signal sequence may be a prokaryotic signal sequence selected, for example, from the group of the alkaline phosphatase, penicillinase, 1pp, or heat-stable enterotoxin II leaders. For yeast secretion the signal sequence may be, e.g., the yeast invertase leader, alpha factor leader (including

*Saccharomyces* and *Kluyveromyces* alpha-factor leaders, the latter described in U.S. Pat. No. 5,010,182), or acid phosphatase leader, the *C. albicans* glucoamylase leader (EP 362,179 published Apr. 4, 1990), or the signal described in WO 90/13646 published Nov. 15, 1990. In mammalian cell expression, mammalian signal sequences may be used to direct secretion of the protein, such as signal sequences from secreted polypeptides of the same or related species, as well as viral secretory leaders.

Both expression and cloning vectors contain a nucleic acid sequence that enables the vector to replicate in one or more selected host cells. Such sequences are well known for a variety of bacteria, yeast, and viruses. The origin of replication from the plasmid pBR322 is suitable for most Gram-negative bacteria, the 2mu plasmid origin is suitable for yeast, and various viral origins (SV40, polyoma, adenovirus, VSV or BPV) are useful for cloning vectors in mammalian cells.

Expression and cloning vectors will typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

An example of suitable selectable markers for mammalian cells are those that enable the identification of cells competent to take up the encoding nucleic acid, such as DHFR or thymidine kinase. An appropriate host cell when wild-type DHFR is employed is the CHO cell line deficient in DHFR activity, prepared and propagated as described by Urlaub et al., Proc. Natl. Acad. Sci. USA, 77:4216 (1980). A suitable selection gene for use in yeast is the trp1 gene present in the yeast plasmid YRp7 (Stinchcomb et al., Nature, 282:39 (1979); Kingsman et al., Gene, 7:141 (1979); Tschemper et al., Gene, 10:157 (1980)). The trp1 gene provides a selection marker for a mutant strain of yeast lacking the ability to grow in tryptophan, for example, ATCC No. 44076 or PEP4-1 (Jones, Genetics, 85:12 (1977)).

Expression and cloning vectors usually contain a promoter operably linked to the encoding nucleic acid sequence to direct mRNA synthesis. Promoters recognized by a variety of potential host cells are well known. Promoters suitable for use with prokaryotic hosts include the beta-lactamase and lactose promoter systems (Chang et al., Nature, 275:615 (1978); Goeddel et al., Nature, 281:544 (1979)), alkaline phosphatase, a tryptophan (trp) promoter system (Goeddel, Nucleic Acids Res., 8:4057 (1980); EP 36,776), and hybrid promoters such as the tac promoter (deBoer et al., Proc. Natl. Acad. Sci. USA, 80:21-25 (1983)). Promoters for use in bacterial systems also will contain a Shine-Dalgarno (S.D.) sequence operably linked to the encoding DNA.

Examples of suitable promoting sequences for use with yeast hosts include the promoters for 3-phosphoglycerate kinase (Hitzeman et al., J. Biol. Chem., 255:2073 (1980)) or other glycolytic enzymes (Hess et al., J. Adv. Enzyme Re.g., 7:149 (1968); Holland, Biochemistry, 17:4900 (1978)), such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Other yeast promoters, which are inducible promoters having the additional advantage of transcription controlled by growth conditions, are the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657.

Transcription from vectors in mammalian host cells is controlled, for example, by promoters obtained from the genomes of viruses such as polyoma virus, fowlpox virus (UK 2,211,504 published Jul. 5, 1989), adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, and from heat-shock promoters, provided such promoters are compatible with the host cell systems.

Transcription of a DNA encoding the stretches of consecutive amino acids or polypeptides of interest by higher eukaryotes may be increased by inserting an enhancer sequence into the vector. Enhancers are cis-acting elements of DNA, usually about from 10 to 300 bp, that act on a promoter to increase its transcription. Many enhancer sequences are now known from mammalian genes (globin, elastase, albumin, alpha-fetoprotein, and insulin). Typically, however, one will use an enhancer from a eukaryotic cell virus. Examples include the SV40 enhancer on the late side of the replication origin (bp 100-270), the cytomegalovirus early promoter enhancer, the polyoma enhancer on the late side of the replication origin, and adenovirus enhancers. The enhancer may be spliced into the vector at a position 5' or 3' to the coding sequence, but is preferably located at a site 5' from the promoter.

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding stretches of consecutive amino acids or polypeptides of interest.

Still other methods, vectors, and host cells suitable for adaptation to the synthesis of stretches of consecutive amino acids or polypeptides in recombinant vertebrate cell culture are described in Gething et al., Nature 293:620-625 (1981); Mantei et al., Nature, 281:4046 (1979); EP 117,060; and EP 117,058.

Detecting Gene Amplification/Expression

Gene amplification and/or expression may be measured in a sample directly, for example, by conventional Southern blotting, Northern blotting to quantitate the transcription of mRNA (Thomas, Proc. Natl. Acad. Sci. USA, 77:5201-5205 (1980)), dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological methods, such as immunohistochemical staining of cells or tissue sections and assay of cell culture or body fluids, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence stretches of consecutive amino acids or polypeptides of interest or against a synthetic peptide based on the DNA sequences provided herein or against exogenous sequence fused to DNA encoding a stretch of consecutive amino acids or polypeptide of interest and encoding a specific antibody epitope.

Purification of Polypeptide

Forms of the stretches of consecutive amino acids or polypeptides of interest may be recovered from culture medium or from host cell lysates. If membrane-bound, it can be released from the membrane using a suitable detergent solution (e.g. Triton-X 100) or by enzymatic cleavage. Cells employed in expression of the stretches of consecutive amino acids or polypeptides of interest can be disrupted by various physical or chemical means, such as freeze-thaw cycling, sonication, mechanical disruption, or cell lysing agents.

It may be desired to purify the stretches of consecutive amino acids or polypeptides of interest from recombinant cell proteins or polypeptides. The following procedures are exemplary of suitable purification procedures: by fractionation on an ion-exchange column; ethanol precipitation; reverse phase HPLC; chromatography on silica or on a cation-exchange resin such as DEAE; chromatofocusing; SDS-PAGE; ammonium sulfate precipitation; gel filtration using, for example, Sephadex G-75; protein A Sepharose columns to remove contaminants such as IgG; and metal chelating columns to bind epitope-tagged forms. Various methods of protein purification may be employed and such methods are known in the art and described for example in Deutscher, Methods in Enzymology, 182 (1990); Scopes, Protein Purification: Principles and Practice, Springer-Verlag, New York (1982). The purification step(s) selected will depend, for example, on the nature of the production process used and the particular stretches of consecutive amino acids or polypeptides of interest produced.

Intein-Based C-Terminal Syntheses

As described, for example, in U.S. Pat. No. 6,849,428, issued Feb. 1, 2005, inteins are the protein equivalent of the self-splicing RNA introns (see Perler et al., Nucleic Acids Res. 22:1125-1127 (1994)), which catalyze their own excision from a precursor protein with the concomitant fusion of the flanking protein sequences, known as exteins (reviewed in Perler et al., Curr. Opin. Chem. Biol. 1:292-299 (1997); Perler, F. B. Cell 92 (1): 1-4 (1998); Xu et al., EMBO J. 15 (19): 5146-5153 (1996)).

Studies into the mechanism of intein splicing led to the development of a protein purification system that utilized thiol-induced cleavage of the peptide bond at the N-terminus of the Sce VMA intein (Chong et al., Gene 192 (2): 271-281 (1997)). Purification with this intein-mediated system generates a bacterially-expressed protein with a C-terminal thioester (Chong et al., (1997)). In one application, where it is described to isolate a cytotoxic protein, the bacterially expressed protein with the C-terminal thioester is then fused to a chemically-synthesized peptide with an N-terminal cysteine using the chemistry described for "native chemical ligation" (Evans et al., Protein Sci. 7:2256-2264 (1998); Muir et al., Proc. Natl. Acad. Sci. USA 95:6705-6710 (1998)).

This technique, referred to as "intein-mediated protein ligation" (IPL), represents an important advance in protein semi-synthetic techniques. However, because chemically-synthesized peptides of larger than about 100 residues are difficult to obtain, the general application of IPL was limited by the requirement of a chemically-synthesized peptide as a ligation partner.

IPL technology was significantly expanded when an expressed protein with a predetermined N-terminus, such as cysteine, was generated, as described for example in U.S. Pat. No. 6,849,428. This allows the fusion of one or more expressed proteins from a host cell, such as bacterial, yeast or mammalian cells. In one non-limiting example the intein a modified RIR1 *Methanobacterium* thermoautotrophicum is that cleaves at either the C-terminus or N-terminus is used which allows for the release of a bacterially expressed protein during a one-column purification, thus eliminating the need proteases entirely.

Intein technology is one example of one route to obtain components. In one embodiment, the subunits of the compounds of the invention are obtained by transfecting suitable cells, capable of expressing and secreting mature chimeric polypeptides, wherein such polypeptides comprise, for example, an adhesin domain contiguous with an isolatable c-terminal intein domain (see U.S. Pat. No. 6,849,428, Evans et al., issued Feb. 1, 2005, hereby incorporated by reference). The cells, such as mammalian cells or bacterial cells, are transfected using known recombinant DNA techniques. The secreted chimeric polypeptide can then be isolated, e.g. using a chitin-derivatized resin in the case of an intein-chitin binding domain (see U.S. Pat. No. 6,897,285, Xu et al., issued May 24, 2005, hereby incorporated by reference), and is then treated under conditions permitting thiol-mediated cleavage and release of the now C-terminal thioester-terminated subunit. The thioester-terminated adhesion subunit is readily converted to a C-terminal cysteine terminated subunit.

For example, following an intein autocleavage reaction, a thioester intermediate is generated that permits the facile addition of cysteine, selenocysteine, homocysteine, or homoselenocysteine, or a derivative of cysteine, selenocysteine, homocysteine, homoselenocysteine, to the C-terminus by native chemical ligation. Methods of adding a cysteine, selenocysteine, homocysteine, or homoselenocysteine, or a derivative of cysteine, selenocysteine, homocysteine, homoselenocysteine, to the C-terminus by native chemical ligation which are useful in aspects of the present invention are described in U.S. Patent Application No. 2008/0254512, Capon, published Oct. 16, 2008, the entire contents of which are hereby incorporated herein by reference.

Examples of Expression of Stretches of Consecutive Amino Acids or Polypeptide Components of Interest in Various Cells In *E. coli*

The DNA sequence encoding the desired amino acid sequence of interest or polypeptide is initially amplified using selected PCR primers. The primers should contain restriction enzyme sites which correspond to the restriction enzyme sites on the selected expression vector. A variety of expression vectors may be employed. An example of a suitable vector is pBR322 (derived from *E. coli*; see Bolivar et al., Gene, 2:95 (1977)) which contains genes for ampicillin and tetracycline resistance. The vector is digested with restriction enzyme and dephosphorylated. The PCR amplified sequences are then ligated into the vector. The vector will preferably include sequences which encode for an antibiotic resistance gene, a trp promoter, a polyhis leader (including the first six STII codons, polyhis sequence, and enterokinase cleavage site), the specific amino acid sequence of interest/polypeptide coding region, lambda transcriptional terminator, and an argU gene.

The ligation mixture is then used to transform a selected *E. coli* strain using the methods described in Sambrook et al., supra. Transformants are identified by their ability to grow on LB plates and antibiotic resistant colonies are then selected. Plasmid DNA can be isolated and confirmed by restriction analysis and DNA sequencing.

Selected clones can be grown overnight in liquid culture medium such as LB broth supplemented with antibiotics. The overnight culture may subsequently be used to inoculate a larger scale culture. The cells are then grown to a desired optical density, during which the expression promoter is turned on.

After culturing the cells for several more hours, the cells can be harvested by centrifugation. The cell pellet obtained by the centrifugation can be solubilized using various agents known in the art, and the solubilized amino acid sequence of interest or polypeptide can then be purified using a metal chelating column under conditions that allow tight binding of the protein.

The primers can contain restriction enzyme sites which correspond to the restriction enzyme sites on the selected expression vector, and other useful sequences providing for efficient and reliable translation initiation, rapid purification on a metal chelation column, and proteolytic removal with enterokinase. The PCR-amplified, poly-His tagged sequences can be ligated into an expression vector used to transform an *E. coli* host based on, for example, strain 52 (W3110 fuhA (tonA) Ion galE rpoHts (htpRts) clpP (lacIq). Transformants can first be grown in LB containing 50 mg/ml carbenicillin at 30° C. with shaking until an O.D.600 of 3-5 is reached. Cultures are then diluted 50-100 fold into C RAP media (prepared by mixing 3.57 g $(NH_4)_2$ $SO_4$, 0.71 g sodium citrate-$2H_2O$, 1.07 g KCl, 5.36 g Difco yeast extract, 5.36 g Sheffield hycase SF in 500 mL water, as well as 110 mM MPOS, pH 7.3, 0.55% (w/v) glucose and 7 mM $MgSO_4$) and grown for approximately 20-30 hours at 30° C. with shaking. Samples were removed to verify expression by SDS-PAGE analysis, and the bulk culture is centrifuged to pellet the cells. Cell pellets were frozen until purification and refolding.

*E. coli* paste from 0.5 to 1 L fermentations (6-10 g pellets) was resuspended in 10 volumes (w/v) in 7 M guanidine, 20 mM Tris, pH 8 buffer. Solid sodium sulfite and sodium tetrathionate is added to make final concentrations of 0.1M and 0.02 M, respectively, and the solution was stirred overnight at 4° C. This step results in a denatured protein with all cysteine residues blocked by sulfitolization. The solution was centrifuged at 40,000 rpm in a Beckman Ultracentifuge for 30 min. The supernatant was diluted with 3-5 volumes of metal chelate column buffer (6 M guanidine, 20 mM Tris, pH 7.4) and filtered through 0.22 micron filters to clarify. Depending the clarified extract was loaded onto a 5 mil Qiagen Ni-NTA metal chelate column equilibrated in the metal chelate column buffer. The column was washed with additional buffer containing 50 mM imidazole (Calbiochem, Utrol grade), pH 7.4. The protein was eluted with buffer containing 250 mM imidazole. Fractions containing the desired protein were pooled and stored at 4 .degree. C. Protein concentration was estimated by its absorbance at 280 nm using the calculated extinction coefficient based on its amino acid sequence.

In Mammalian Cells

This general example illustrates a preparation of a glycosylated form of a desired amino acid sequence of interest or polypeptide component by recombinant expression in mammalian cells.

The vector pRK5 (see EP 307,247, published Mar. 15, 1989) can be employed as the expression vector. Optionally, the encoding DNA is ligated into pRK5 with selected restriction enzymes to allow insertion of the DNA using ligation methods such as described in Sambrook et al., supra.

In one embodiment, the selected host cells may be 293 cells. Human 293 cells (ATCC CCL 1573) are grown to confluence in tissue culture plates in medium such as DMEM supplemented with fetal calf serum and optionally, nutrient components and/or antibiotics. About 10 μg of the ligated vector DNA is mixed with about 1 μg DNA encoding the VA RNA gene [Thimmappaya et al., Cell 31:543 (1982)] and dissolved in 500 μl of 1 mM Tris-HCl, 0.1 mM EDTA, 0.227 M $CaCl_2$) To this mixture is added, dropwise, 500 μl of 50 mM HEPES (pH 7.35), 280 mM NaCl, 1.5 mM $NaPO_4$, and a precipitate is allowed to form for 10 minutes at 25° C. The precipitate is suspended and added to the 293 cells and allowed to settle for about four hours at 37° C. The culture medium is aspirated off and 2 ml of 20% glycerol in PBS is added for 30 seconds. The 293 cells are then washed with serum free medium, fresh medium is added and the cells are incubated for about 5 days.

Approximately 24 hours after the transfections, the culture medium is removed and replaced with culture medium (alone) or culture medium containing 200 μCi/ml $^{35}$S-cysteine and 200 μCi/ml $^{35}$S-methionine. After a 12 hour incubation, the conditioned medium is collected, concentrated on a spin filter, and loaded onto a 15% SDS gel. The processed gel may be dried and exposed to film for a selected period of time to reveal the presence of amino acid sequence of interest or polypeptide component. The cultures containing transfected cells may undergo further incubation (in serum free medium) and the medium is tested in selected bioassays.

In an alternative technique, the nucleic acid amino acid sequence of interest or polypeptide component may be introduced into 293 cells transiently using the dextran sulfate method described by Somparyrac et al., Proc. Natl. Acad. Sci., 12:7575 (1981). 293 cells are grown to maximal density in a spinner flask and 700 μg of the ligated vector is added. The cells are first concentrated from the spinner flask by centrifugation and washed with PBS. The DNA-dextran precipitate is incubated on the cell pellet for four hours. The cells are treated with 20% glycerol for 90 seconds, washed with tissue culture medium, and re-introduced into the spinner flask containing tissue culture medium, 5 μg/ml bovine insulin and 0.1 μg/ml bovine transferrin. After about four days, the conditioned media is centrifuged and filtered to remove cells and debris. The sample containing expressed amino acid sequence of interest or polypeptide component can then be concentrated and purified by any selected method, such as dialysis and/or column chromatography.

In another embodiment, the amino acid sequence of interest or polypeptide component can be expressed in CHO cells. The amino acid sequence of interest or polypeptide component can be transfected into CHO cells using known reagents such as $CaPO_4$ or DEAE-dextran. As described above, the cell cultures can be incubated, and the medium replaced with culture medium (alone) or medium containing a radiolabel such as $^{35}$S-methionine. After determining the presence of amino acid sequence of interest or polypeptide component, the culture medium may be replaced with serum free medium. Preferably, the cultures are incubated for about 6 days, and then the conditioned medium is harvested. The medium containing the expressed amino acid sequence of interest or polypeptide component can then be concentrated and purified by any selected method.

Epitope-tagged amino acid sequence of interest or polypeptide component may also be expressed in host CHO cells. The amino acid sequence of interest or polypeptide component may be subcloned out of a pRK5 vector. The subclone insert can undergo PCR to fuse in frame with a selected epitope tag such as a poly-his tag into a Baculovirus expression vector. The poly-his tagged amino acid sequence of interest or polypeptide component insert can then be subcloned into a SV40 driven vector containing a selection marker such as DHFR for selection of stable clones. Finally, the CHO cells can be transfected (as described above) with the SV40 driven vector. Labeling may be performed, as described above, to verify expression. The culture medium containing the expressed poly-His tagged amino acid sequence of interest or polypeptide component can then be concentrated and purified by any selected method, such as by $Ni^{2+}$-chelate affinity chromatography.

In an embodiment the amino acid sequence of interest or polypeptide component are expressed as an IgG construct (immunoadhesin), in which the coding sequences for the soluble forms (e.g. extracellular domains) of the respective proteins are fused to an IgG1 constant region sequence containing the hinge, $CH_2$ and $CH_2$ domains and/or is a poly-His tagged form.

Following PCR amplification, the respective DNAs are subcloned in a CHO expression vector using standard techniques as described in Ausubel et al., Current Protocols of Molecular Biology, Unit 3.16, John Wiley and Sons (1997). CHO expression vectors are constructed to have compatible restriction sites 5' and 3' of the DNA of interest to allow the convenient shuttling of cDNA's. The vector used in expression in CHO cells is as described in Lucas et al., Nucl. Acids Res. 24:9 (1774-1779 (1996), and uses the SV40 early promoter/enhancer to drive expression of the cDNA of interest and dihydrofolate reductase (DHFR). DHFR expression permits selection for stable maintenance of the plasmid following transfection.

In Yeast

The following method describes recombinant expression of a desired amino acid sequence of interest or polypeptide component in yeast.

First, yeast expression vectors are constructed for intracellular production or secretion of a stretch of consecutive amino acids from the ADH2/GAPDH promoter. DNA encoding a desired amino acid sequence of interest or polypeptide component, a selected signal peptide and the promoter is inserted into suitable restriction enzyme sites in the selected plasmid to direct intracellular expression of the amino acid sequence of interest or polypeptide component. For secretion, DNA encoding the stretch of consecutive amino acids can be cloned into the selected plasmid, together with DNA encoding the ADH2/GAPDH promoter, the yeast alpha-factor secretory signal/leader sequence, and linker sequences (if needed) for expression of the stretch of consecutive amino acids.

Yeast cells, such as yeast strain AB110, can then be transformed with the expression plasmids described above and cultured in selected fermentation media. The transformed yeast supernatants can be analyzed by precipitation with 10% trichloroacetic acid and separation by SDS-PAGE, followed by staining of the gels with Coomassie Blue stain.

Recombinant amino acid sequence of interest or polypeptide component can subsequently be isolated and purified by removing the yeast cells from the fermentation medium by centrifugation and then concentrating the medium using selected cartridge filters. The concentrate containing the amino acid sequence of interest or polypeptide component may further be purified using selected column chromatography resins.

In Baculovirus-Infected Insect Cells

The following method describes recombinant expression of stretches of consecutive amino acids in Baculovirus-infected insect cells.

The desired nucleic acid encoding the stretch of consecutive amino acids is fused upstream of an epitope tag contained with a baculovirus expression vector. Such epitope tags include poly-his tags and immunoglobulin tags (like Fc regions of IgG). A variety of plasmids may be employed, including plasmids derived from commercially available plasmids such as pVL1393 (Novagen). Briefly, the amino acid sequence of interest or polypeptide component or the desired portion of the amino acid sequence of interest or polypeptide component (such as the sequence encoding the extracellular domain of a transmembrane protein) is amplified by PCR with primers complementary to the 5' and 3' regions. The 5' primer may incorporate flanking (selected) restriction enzyme sites. The product is then digested with those selected restriction enzymes and subcloned into the expression vector.

Recombinant baculovirus is generated by co-transfecting the above plasmid and BaculoGold™ virus DNA (Pharmingen) into *Spodoptera frugiperda* ("Sf9") cells (ATCC CRL 1711) using lipofectin (commercially available from GIBCO-BRL). After 4-5 days of incubation at 28° C., the released viruses are harvested and used for further amplifications. Viral infection and protein expression is performed as described by O'Reilley et al., Baculovirus expression vectors: A laboratory Manual, Oxford: Oxford University Press (1994).

Expressed poly-his tagged amino acid sequence of interest or polypeptide component can then be purified, for example, by $Ni^{2+}$-chelate affinity chromatography as follows. Extracts are prepared from recombinant virus-infected Sf9 cells as described by Rupert et al., Nature, 362:175-179 (1993). Briefly, Sf9 cells are washed, resuspended in sonication buffer (25 mL Hepes, pH 7.9; 12.5 mM $MgCl_2$; 0.1 mM EDTA; 10% Glycerol; 0.1% NP40; 0.4 M KCl), and sonicated twice for 20 seconds on ice. The sonicates are cleared by centrifugation, and the supernatant is diluted 50-fold in loading buffer (50 mM phosphate, 300 mM NaCl, 10% Glycerol, pH 7.8) and filtered through a 0.45 μm filter. A $Ni^{2+}$-NTA agarose column (commercially available from Qiagen) is prepared with a bed volume of 5 mL, washed with 25 mL of water and equilibrated with 25 mL of loading buffer. The filtered cell extract is loaded onto the column at 0.5 mL per minute. The column is washed to baseline $A_{280}$ with loading buffer, at which point fraction collection is started. Next, the column is washed with a secondary wash buffer (50 mM phosphate; 300 mM NaCl, 10% Glycerol, pH 6.0), which elutes nonspecifically bound protein. After reaching $A_{280}$ baseline again, the column is developed with a 0 to 500 mM Imidazole gradient in the secondary wash buffer. One mL fractions are collected and analyzed by SDS-PAGE and silver staining or western blot with $Ni^{2+}$-NTA-conjugated to alkaline phosphatase (Qiagen). Fractions containing the eluted His 10-tagged sequence are pooled and dialyzed against loading buffer.

Alternatively, purification of the IgG tagged (or Fc tagged) amino acid sequence can be performed using known chromatography techniques, including for instance, Protein A or Protein G column chromatography.

Fc containing constructs of proteins can be purified from conditioned media as follows. The conditioned media is pumped onto a 5 ml Protein A column (Pharmacia) which is equilibrated in 20 mM Na phosphate buffer, pH 6.8. After loading, the column is washed extensively with equilibration buffer before elution with 100 mM citric acid, pH 3.5. The eluted protein is immediately neutralized by collecting 1 ml fractions into tubes containing 275 mL of 1 M Tris buffer, pH 9. The highly purified protein is subsequently desalted into storage buffer as described above for the poly-His tagged proteins. The homogeneity of the proteins is verified by SDS polyacrylamide gel (PEG) electrophoresis and N-terminal amino acid sequencing by Edman degradation.

Examples of Pharmaceutical Compositions

Non-limiting examples of compositions and dosages of the invention are set forth as follows:

Etanercept and Related Compositions

Compositions comprising tetrahedral or octahedral antibodies wherein one or more domains of tetrahedral or octahedral antibodies comprise consecutive amino acids having the sequence of etanercept (e.g. Enbrel) or the sequence of one or more domains thereof, may comprise mannitol, sucrose, and tromethamine. In an embodiment, the composition is in the form of a lyophilizate. In an embodiment, the composition is reconstituted with, for example, Sterile Bacteriostatic Water for Injection (BWFI), USP (containing 0.9% benzyl alcohol). In an embodiment the compound is administered to a subject for reducing signs and symptoms, inducing major clinical response, inhibiting the progression of structural damage, and improving physical function in subjects with moderately to severely active rheumatoid arthritis. The compound may be initiated in combination with methotrexate (MTX) or used alone. In an embodiment the compound is administered to a subject for reducing signs and symptoms of moderately to severely active polyarticular-course juvenile rheumatoid arthritis in subjects who have had an inadequate response to one or more DMARDs. In an embodiment the compound is administered to a subject for reducing signs and symptoms, inhibiting the progression of structural damage of active arthritis, and improving physical function in subjects with psoriatic arthritis. In an embodiment the compound is administered to a subject for reducing signs and symptoms in subjects with active ankylosing spondylitis. In an embodiment the compound is administered to a subject for the treatment of chronic moderate to severe plaque psoriasis. In an embodiment wherein the subject has rheumatoid arthritis, psoriatic arthritis, or ankylosing spondylitis the compound is administered at 25-75 mg per week given as one or more subcutaneous (SC) injections. In a further embodiment the compound is administered at 50 mg per week in a single SC injection. In an embodiment wherein the subject has plaque psoriasis the compound is administered at 25-75 mg twice weekly or 4 days apart for 3 months followed by a reduction to a maintenance dose of 25-75 mg per week. In a further embodiment the compound is administered at a dose of at 50 mg twice weekly or 4 days apart for 3 months followed by a reduction to a maintenance dose of 50 mg per week. In an embodiment the dose is between 2× and 100× less than the doses set forth herein. In an embodiment wherein the subject has active polyarticular-course JRA the compound may be administered at a dose of 0.2-1.2 mg/kg per week (up to a maximum of 75 mg per week). In a further embodiment the compound is administered at a dose of 0.8 mg/kg per week (up to a maximum of 50 mg per week). In some embodiments the dose is between 2× and 100× less than the doses set forth hereinabove.

Infliximab, Adalimumab, and Related Compositions

Compositions comprising tetrahedral or octahedral antibodies wherein one or more domains of tetrahedral or octahedral antibodies comprise consecutive amino acids having the sequence of infliximab (e.g. Remicade) or the sequence of one or more domains thereof, may comprise sucrose, polysorbate 80, monobasic sodium phosphate, monohydrate, and dibasic sodium phosphate, dihydrate. Preservatives are not present in one embodiment. In an embodiment, the composition is in the form of a lyophilizate. In an embodiment, the composition is reconstituted with, for example, Water for Injection (BWFI), USP, In an embodiment the pH of the composition is 7.2 or is about 7.2. In one embodiment the compound is administered is administered to a subject with rheumatoid arthritis in a dose of 2-4 mg/kg given as an intravenous infusion followed with additional similar doses at 2 and 6 weeks after the first infusion then every 8 weeks thereafter. In a further embodiment the compound is administered in a dose of 3 mg/kg given as an intravenous infusion followed with additional similar doses at 2 and 6 weeks after the first infusion then every 8 weeks thereafter. In an embodiment the dose is adjusted up to 10 mg/kg or treating as often as every 4 weeks. In an embodiment the compound is administered in combination with methotrexate. In one embodiment the compound is administered to a subject with Crohn's disease or fistulizing Crohn's disease at dose of 2-7 mg/kg given as an induction regimen at 0, 2 and 6 weeks followed by a maintenance regimen of 4-6 mg/kg every 8 weeks thereafter for the treatment of moderately to severely active Crohn's disease or fistulizing disease. In a further embodiment the compound is administered at a dose of 5 mg/kg given as an induction regimen at 0, 2 and 6 weeks followed by a maintenance regimen of 5 mg/kg every 8 weeks thereafter for the treatment of moderately to severely active Crohn's disease or fistulizing disease. In an embodiment the dose is adjusted up to 10 mg/kg. In one embodiment the compound is administered to a subject with ankylosing spondylitis at a dose of 2-7 mg/kg given as an intravenous infusion followed with additional similar doses at 2 and 6 weeks after the first infusion, then every 6 weeks thereafter. In a further embodiment the compound is administered at a dose of 5 mg/kg given as an intravenous infusion followed with additional similar doses at 2 and 6 weeks after the first infusion, then every 6 weeks thereafter. In one embodiment the compound is administered to a subject with psoriatic arthritis at a dose of 2-7 mg/kg given as an intravenous infusion followed with additional similar doses at 2 and 6 weeks after the first infusion then every 8 weeks thereafter. In a further embodiment the compound is administered at a dose of 5 mg/kg given as an intravenous infusion followed with additional similar doses at 2 and 6 weeks after the first infusion then every 8 weeks thereafter. In an embodiment the compound is administered with methotrexate. In one embodiment the compound is administered to a subject with ulcerative colitis at a dose of 2-7 mg/kg given as an induction regimen at 0, 2 and 6 weeks followed by a maintenance regimen of 2-7 mg/kg every 8 weeks thereafter for the treatment of moderately to severely active ulcerative colitis. In a further embodiment the compound is administered to a subject with ulcerative colitis at a dose of 5 mg/kg given as an induction regimen at 0, 2 and 6 weeks followed by a maintenance regimen of 5 mg/kg every 8 weeks thereafter. In some embodiments the dose is between 2× and 100× less than the doses set forth hereinabove for treating the individual diseases.

Rituximab, Ocrelizumab, and Related Compositions

Compositions comprising tetrahedral or octahedral antibodies wherein one or more domains of tetrahedral or octahedral antibodies comprise consecutive amino acids having the sequence of rituximab, ocrelizumab, or the sequence of one or more domains thereof, may comprise sodium chloride, sodium citrate dihydrate, sodium citrate dihydrate, and Sterile Water for Injection. In an embodiment, the composition is provided in a sterile, clear, colourless, preservative-free liquid concentrate for intravenous (IV) administration. In an embodiment, the composition is supplied at a concentration of 10 mg/ml. In an embodiment, the product is formulated for intravenous administration in 9.0 mg/ml sodium chloride, 7.35 mg/ml sodium citrate dihydrate, 0.7 mg/ml polysorbate 80, and Sterile Water for Injection. In an embodiment the pH of the composition is 6.5 or about 6.5. In an embodiment, the composition comprises the tetrahedral or octahedral antibody at a concentration of 30 mg/mL in 20 mM sodium acetate, 106 mM trehalose dihydrate, 0.02% (w/v) polysorbate 20, at pH 5.3.

Blinatumomab, and Related Compositions

Compositions comprising tetrahedral or octahedral antibodies wherein one or more domains of tetrahedral or octahedral antibodies comprise consecutive amino acids having the sequence of blinatumomab, or the sequence of one or more domains thereof, may comprise citric acid monohydrate (E330), trehalose dihydrate, lysine hydrochloride, polysorbate 80, sodium hydroxide (for pH-adjustment), and water for injections. In an embodiment, the pH is 7 or about 8. For treatment of relapsed or refractory B-precursor ALL, the dose depends on the patient's bodyweight. The composition is infused continuously during a treatment cycle of 4 weeks. Each cycle of treatment is separated by a 2-week treatment-free interval. Patients who have no signs of cancer after 2 cycles may be treated with up to 3 additional cycles of treatment. For treatment of patients with minimal residual disease, the dose depends on the patient's bodyweight. The composition is infused continuously during a treatment cycle of 4 weeks. Patients may be treated for up to 3 additional treatment cycles, each one given after a 2-week treatment-free interval.

ACE2 and Related Compositions

Compositions comprising tetrahedral or octahedral antibodies wherein one or more domains of tetrahedral or octahedral antibodies comprise consecutive amino acids having the sequence of ACE2 or portions thereof, may comprise known excipients such as those discussed in the sections above. Such compositions may be used, for example, for treatment of SARS-CoV-2.

In each of the embodiments of the compositions described herein, the compositions, when in the form of a lyophilizate, may be reconstituted with, for example, sterile aqueous solutions, sterile water, Sterile Water for Injections (USP), Sterile Bacteriostatic Water for Injections (USP), and equivalents thereof known to those skilled in the art.

It is understood that in administration of any of the instant compounds, the compound may be administered in isolation, in a carrier, as part of a pharmaceutical composition, or in any appropriate vehicle.

Dosage

It is understood that where a dosage range is stated herein, e.g. 1-10 mg/kg per week, the invention disclosed herein also contemplates each integer dose, and tenth thereof, between the upper and lower limits. In the case of the example given, therefore, the invention contemplates 1.0, 1.1, 1.2, 1.3, 1.4, 1.5, 1.6, 1.7, 1.8, 1.9, 2.0, 2.1, 2.2, 2.3, 2.4 etc. mg/kg up to 10 mg/kg.

In embodiments, the compounds of the present invention can be administered as a single dose or may be administered as multiple doses.

In general, the daily dosage for treating a disorder or condition according to the methods described above will generally range from about 0.01 to about 10.0 mg/kg body weight of the subject to be treated.

Variations based on the aforementioned dosage ranges may be made by a physician of ordinary skill taking into account known considerations such as the weight, age, and condition of the person being treated, the severity of the affliction, and the particular route of administration chosen.

It is also expected that the compounds disclosed will affect cooperative binding with attendant consequences on effective dosages required.

Pharmaceuticals

The term "pharmaceutically acceptable carrier" is understood to include excipients, carriers or diluents. The particular carrier, diluent or excipient used will depend upon the means and purpose for which the active ingredient is being applied.

For parenteral administration, solutions containing a compound of this invention or a pharmaceutically acceptable salt thereof in sterile aqueous solution may be employed. Such aqueous solutions should be suitably buffered if necessary and the liquid diluent first rendered isotonic with sufficient saline or glucose. These particular aqueous solutions are especially suitable for intravenous, intramuscular, subcutaneous and intraperitoneal administration. The sterile aqueous media employed are all readily available by standard techniques known to those skilled in the art.

The compositions of this invention may be in a variety of forms. These include, for example, liquid, semi-solid and solid dosage forms, such as liquid solutions (e.g., injectable and infusible solutions), dispersions or suspensions. The preferred form depends on the intended mode of administration and therapeutic application. Some compositions are in the form of injectable or infusible solutions. A mode of administration is parenteral (e.g., intravenous, subcutaneous, intraperitoneal, intramuscular). In an embodiment, the compound is administered by intravenous infusion or injection. In another embodiment, the compound is administered by intramuscular or subcutaneous injection. In another embodiment, the compound is administered intranasally.

For therapeutic use, the compositions disclosed here can be administered in various manners, including soluble form by bolus injection, continuous infusion, sustained release from implants, oral ingestion, local injection (e.g. intracrdiac, intramuscular), systemic injection, or other suitable techniques well known in the pharmaceutical arts. Other methods of pharmaceutical administration include, but are not limited to oral, subcutaneously, transdermal, intravenous, intramuscular and parenteral methods of administration. Typically, a soluble composition will comprise a purified compound in conjunction with physiologically acceptable carriers, excipients or diluents. Such carriers will be nontoxic to recipients at the dosages and concentrations employed. The preparation of such compositions can entail combining a compound with buffers, antioxidants, carbohydrates including glucose, sucrose or dextrins, chelating agents such as EDTA, glutathione and other stabilizers and excipients. Neutral buffered saline or saline mixed with conspecific serum albumin are exemplary appropriate diluents. The product can be formulated as a lyophilizate using appropriate excipient solutions (e.g., sucrose) as diluents.

Other derivatives comprise the compounds/compositions of this invention covalently bonded to a nonproteinaceous polymer. The bonding to the polymer is generally conducted so as not to interfere with the preferred biological activity of the compound, e.g. the binding activity of the compound to a target. The nonproteinaceous polymer ordinarily is a hydrophilic synthetic polymer, i.e., a polymer not otherwise found in nature. However, polymers which exist in nature and are produced by recombinant or in vitro methods are useful, as are polymers which are isolated from nature. Hydrophilic polyvinyl polymers fall within the scope of this invention, e.g. polyvinylalcohol and polyvinylpyrrolidone. Particularly useful are polyalkylene ethers such as polyethylene glycol, polypropylene glycol, polyoxyethylene esters or methoxy polyethylene glycol; polyoxyalkylenes such as polyoxyethylene, polyoxypropylene, and block copolymers of polyoxyethylene and polyoxypropylene (Pluronics); polymethacrylates; carbomers; branched or unbranched polysaccharides which comprise the saccharide monomers D-mannose, D- and L-galactose, fucose, fructose, D-xylose, L-arabinose, D-glucuronic acid, sialic acid, D-galacturontc acid, D-mannuronic acid (e.g. polymannuronic acid, or alginic acid), D-glucosamine, D-galactosamine, D-glucose and neuraminic acid including homopolysaccharides and heteropolysaccharides such as lactose, amylopectin, starch, hydroxyethyl starch, amylose, dextran sulfate, dextran, dextrins, glycogen, or the polysaccharide subunit of acid mucopolysaccharides, e.g. hyaluronic acid; polymers of sugar alcohols such as polysorbitol and polymannitol; as well as heparin or heparon.

The pharmaceutical compositions of the invention may include a "therapeutically effective amount" or a "prophylactically effective amount" of a compound of the invention. A "therapeutically effective amount" refers to an amount effective, at dosages and for periods of time necessary, to achieve the desired therapeutic result. A therapeutically effective amount of the compound may vary according to factors such as the disease state, age, sex, and weight of the individual. A therapeutically effective amount is also one in which any toxic or detrimental effects of the compound are outweighed by the therapeutically beneficial effects. A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

General

All combinations of the various elements disclosed herein are within the scope of the invention.

As used herein, all headings are simply for organization and are not intended to limit the disclosure in any manner. The content of any individual section may be equally applicable to all sections. All combinations of the various elements disclosed herein are within the scope of the invention.

Additional objects, advantages, and novel features of the present invention will become apparent to one ordinarily skilled in the art upon examination of the following examples, which are not intended to be limiting. Additionally, each of the various embodiments and aspects of the present invention as delineated hereinabove and as claimed in the claims section below finds experimental support in the following examples.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination or as suitable in any other described embodiment of the invention. Certain features described in the context of various embodiments are not to be considered essential features of those embodiments, unless the embodiment is inoperative without those elements.

This invention will be better understood by reference to the Examples which follow, but those skilled in the art will readily appreciate that the specific experiments detailed are only illustrative of the invention as described more fully in the claims which follow thereafter. In the Examples that follow and in their associated figures, exemplary proteins of the invention are described by reference to unique protein ID numbers (i.e. protein ID 15-07) or HB number (i.e. HB1507). HB numbers correspond to the protein ID numbers used herein, except that they lack a hyphen (i.e. HB1507 corresponds to protein ID 15-07).

EXAMPLES

Example 1—Methods and Materials

Recombinant Proteins

Recombinant proteins were expressed in Chinese hamster ovary (CHO) cells using a mammalian expression vector and purified by Protein A affinity chromatography and size-exclusion chromatography (SEC). Production was carried out by transient expression in CHO-K1 cells adapted to serum-free suspension culture (TunaCHO, LakePharma Inc., Belmont, CA). Suspension CHO cells were seeded in a shake flask and expanded using a serum-free and chemically defined medium. On the day of transfection, the expanded cells were seeded into a new vessel with fresh medium. Transient transfections were done with the addition of transfection reagents complexed with DNA under high density conditions. Transfections were carried out in cultures of 0.1 to 2.0 liters. After transfection, the cells were maintained as a batch-fed culture in a shake flask until the end of the production run. The conditioned cell culture fluid was harvested after 7 to 14 days, clarified by centrifugation, and sterile-filtered prior to purification.

Protein A affinity chromatography was carried out by applying the culture supernatant to a column packed with CaptivA® Protein A Affinity Resin (Repligen, Massachusetts, USA) pre-equilibrated with 137 mM NaCl 2.7 mM KCl 10 mM Na2HPO4 2 mM KH2PO4 pH 7.4 (PBS). The column was washed with PBS buffer until the OD280 value returned to baseline. The target protein was then eluted with 0.25% acetic acid buffer at pH 3.5. Fractions were collected, buffered with 1 M HEPES, and the OD280 value of each fraction was recorded. Fractions containing the target protein were pooled, buffer exchanged into 100 mM HEPES, 100 mM NaCl, 50 mM NaOAc, pH 6.0, and filtered through a 0.2 μm membrane filter and stored at 4° C. prior to use. The protein concentration was calculated from the OD280 value and the calculated extinction coefficient.

Preparative SEC was carried out using an AKTA Avant 25 FPLC system (GE Healthcare, Uppsala, Sweden). Proteins were first concentrated to 10-15 mg/ml using an Amicon Ultra-15, 3MWCO, ultracentrifugal filter unit, catalog #UFC900324 (Millipore, Burlington, MA), then loaded onto a HiLoad 26/600 Superdex 200 prep grade column (GE Healthcare). Elution was carried out with Dulbecco's phosphate-buffered saline without calcium or magnesium salts (PBS) (UCSF Cell Culture Facility, San Francisco, CA) containing 10 mM EDTA. Fractions corresponding to the protein of interest were identified based upon analytical SEC and analysis by reducing and non-reducing SDS-PAGE, and pooled, concentrated by ultrafiltration, and stored at 4° C.

Heterobifunctional Crosslinkers

TABLE 1

Heterobifunctional Crosslinkers

| Name | Formula | Mol Wt | Sequence | Manufacture | Item # |
|---|---|---|---|---|---|
| Az-thioester | $C_{32}H_{45}O_{10}N_{11}S$ | 775.83 | Azidoacetyl-DKTHT-thiophenol | CPC Scientific Inc | 860245 |
| Az-P12-thioester | $C_{59}H_{98}O_{23}N_{12}S$ | 1375.54 | Azide-PEG$_{12}$-DHTHT-thiophenol | CPC Scientific Inc | 852119 |
| Az-P24-thioester | $C_{83}H_{146}O_{35}N_{12}S$ | 1904.17 | Azide-PEG$_{24}$-DHTHT-thiophenol | CPC Scientific Inc | 834144 |
| Az-P36-thioester | $C_{107}H_{194}O_{47}N_{12}S$ | 2432.79 | Azide-PEG$_{36}$-DHTHT-thiophenol | CPC Scientific Inc | 860249 |
| Az-P48-thioester | $C_{134}H_{247}O_{60}N_{13}S$ | 3032.50 | Azidoacetyl-PEG$_{36}$PEG$_{12}$-DKTHT-thiophenol | CPC Scientific Inc | 869441 |
| Tet-DBCO | $C_{34}H_{33}N_{7}O_{7}S$ | 683.70 | Methyltetrazine-Sulfo-DBCO | Click Chemistry Tools | 1022 |
| TCO-P4-DBCO | $C_{41}H_{54}N_{4}O_{12}S$ | 826.95 | Trans-Cyclooctene-Sulfo-PEG$_{4}$-DBCO | Click Chemistry Tools | 1005 |
| Tet-P4-Mal | $C_{24}H_{30}N_{6}O_{7}$ | 514.53 | Methyltetrazine-PEG$_{4}$-Maleimide | Click Chemistry Tools | 1068 |
| TCO-P3-Mal | $C_{26}H_{41}N_{3}O_{8}$ | 523.62 | Trans-Cyclooctene-PEG$_{3}$-Maleimide | Click Chemistry Tools | 1002 |
| TCO-P12-Mal | $C_{46}H_{80}N_{4}O_{18}$ | 977.14 | Trans-Cyclooctene-PEG$_{12}$-Maleimide | AnaSpecInc | 659252 |
| TCO-P24-Mal | $C_{70}H_{128}N_{4}O_{30}$ | 1505.77 | Trans-Cyclooctene-PEG$_{24}$-Maleimide | AnaSpecInc | 659254 |
| TCO-P36-Mal | $C_{94}H_{176}N_{4}O_{42}$ | 2034.40 | Trans-Cyclooctene-PEG$_{36}$-Maleimide | AnaSpecInc | 659256 |

Electrospray Ionization Mass Spectrometry (ESI-MS)

Intact proteins were analyzed by ESI-MS using a Model 1260 HPLC system (Agilent Technologies, Santa Clara, CA) and MicroTOF-QII MS system (Bruker Corporation, Billerica, MA). A BioResolve RP mAb Polyphenyl column with a 2.7 micron particle size, 450 angstrom pore size, and dimensions of 2.1×100 mm (Waters Corporation, Milford, MA) was used at 50° C. with a flow rate of 0.3 ml/min, and injection volume of 2-5 uL. The mobile phase was a gradient of 0.1% formic acid in water (solvent A) and 0.1% formic acid in acetonitrile (solvent B) as follows: 0 min, 95%: 5%; 2 min, 65%: 35%; 10 min, 54%: 46%; 11 min, 5%: 95% held for 3 minutes. Data was collected in full scan MS mode with a mass range of 600-4000 Da. The collision RF setting was 800 Vpp. For deglycosylation analysis, samples were reduced and deglycosylated with Rapid PNGase F, P0710S (New England BioLabs Inc, Ipswich, MA) according to the manufacturer's instructions. Bruker DataAnalysis Version 4.0 SP4 software was used for mass spectral display and deconvolution.

Analytical Size-Exclusion HPLC (SE-HPLC)

Analytical SE-HPLC was carried out using a Prominence HPLC system (Shimadzu Corporation, Kyoto, Japan). Zenix-C columns with a 3 micron particle size, 300 angstrom pore size, and dimensions of 4.6×300 mm (Sepax Technologies, Newark, Delaware) were used individually or as a pair of columns connected in series. Mobile phase, flow rate, column temperature, and detection wavelength used were 50 mM sodium phosphate pH 7.4 and 300 mM NaCl, 0.2 mL/min, 25° C., and 280/214 nm, respectively. LabSolutions v5.9 software (Shimadzu Corporation) was used for UV data acquisition and processing.

Multi-Angle Light Scattering Analysis (MALS)

The molar mass of proteins was determined by combining SE-HPLC with measurement of refractive index (RI) and multi-angle light scattering (SEC-MALS) using an Optilab T-rEX RI detector and Treos MALS detector in-line (Wyatt Technology, Goleta, CA). The temperature of detectors was maintained at 25° C. The signal obtained for the monomeric form of bovine serum albumin (BSA) was used to normalize the detectors and to correct for band broadening between detectors. Astra v7.3 software (Wyatt Technology) was used for light scattering and refractive index data acquisition and processing. A value of 0.185 mL/g was used for the dn/dc ratio of proteins.

Stoichiometric Binding Measurements by SE-HPLC

The relative binding affinities of two distinct proteins to a common ligand-binding partner was determined by stoichiometric binding analysis using SE-HPLC. Partially purified mixtures of the two proteins, or mixtures prepared by combining two purified proteins, were assessed for the relative binding affinity of their constituents in a binding reaction containing a molar ratio of 0.2 to 2.0 of the ligand-binding partner. Following incubation for two hours at 25° C., binding reaction were analyzed by SE-HPLC to determine the remaining unbound fraction of each of the two proteins.

Kinetic Exclusion Assay (KinExA®)

Equilibrium binding affinity and kinetic binding measurements were made between unmodified molecules in solution using a KinExA 3200 instrument (Sapidyne Instruments, Boise, Idaho). For Kd analysis of ACE2 binding to SARS-CoV-2 S protein, PMMA beads were adsorption-coated with recombinant SARS-CoV-2 spike protein, Reference No. 46328 (LakePharma Inc, Belmont, CA); then used as the solid-phase to capture the ACE2 protein (the constant binding partner (CBP)). For each experiment, S protein was titrated in a background of the ACE2 protein and allowed to reach equilibrium. The binding reactions were then briefly exposed to the solid phase and a portion of free ACE2 protein was captured and then detected with a fluorescent secondary molecule. The short contact time with the solid phase is less than the time needed for dissociation of the pre-formed complex in solution, thus competition between the solution and the solid phase titrated binding partner is "kinetically excluded." Since the solid phase is only used as a probe for the free CBP in each sample, the solution equilibrium is not altered during such KinExA measurements.

Octet

Kinetic Assay on Fc Gamma Receptors

The kinetic characterization of antibody binding on Fc gamma receptors were performed on a Octet Red384 (Satorius) using 384-well plates.

Various recombinant human Fc gamma receptors containing polyhistidine tag at C-terminus were purchased from R&D systems. The Fc gamma receptors with concentration of 5 μg/ml were immobilized on Anti-Penta-His biosensors (Satorius) in PBS-B (PBS with 1 mg/mL BSA, pH 7.4) at 26° C. with the orbital shake speed of 1000 rpm. After washing with PBS-B, the Fc gamma receptors captured biosensors were submerged in different concentrations of testing antibodies for 15 seconds. The biosensors were then submerged in PBS-B for 60 seconds during dissociation. Biosensors were regenerated by stripping with glycine pH1.5 at the end of each cycle. Data analysis was conducted using a standard 1:1 binding model.

Figure 1:
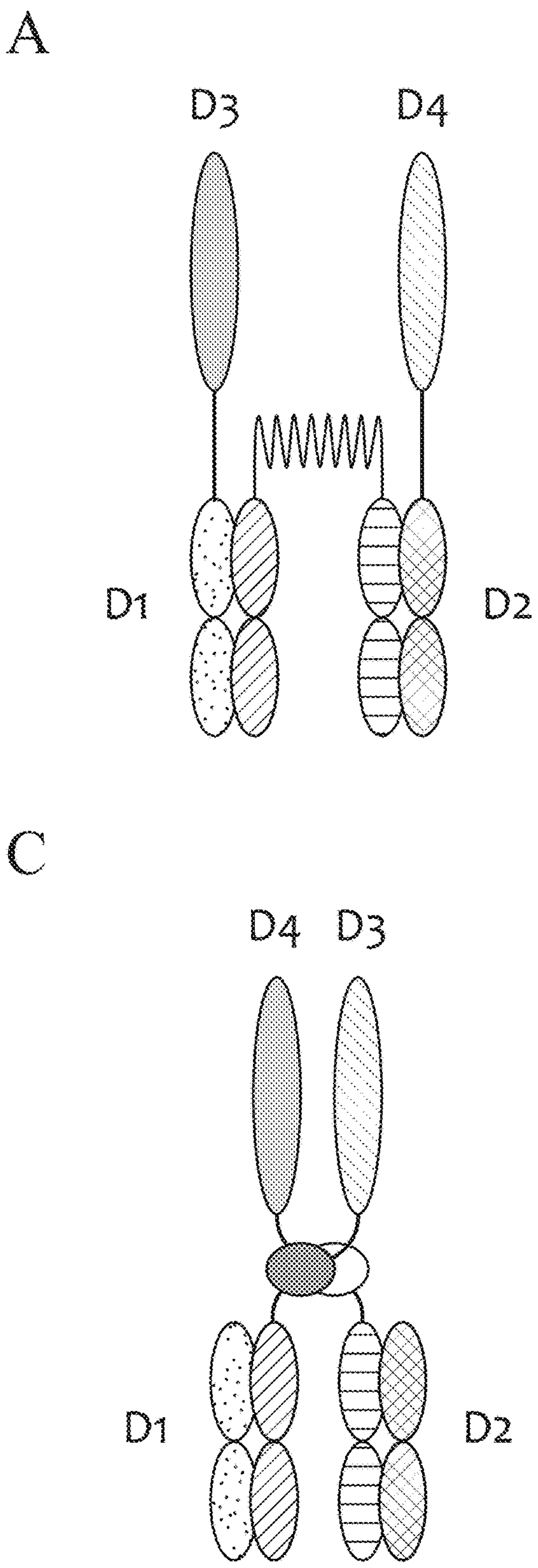
FIG. 1: General schematic structure of tetrahedral antibodies showing the positions of domains D1, D2, D3, D4 (A-D), and D5 and D6 (D), and the positions of the covalent linkage (A) and non-covalent linkage (B-D).
Figure 2:
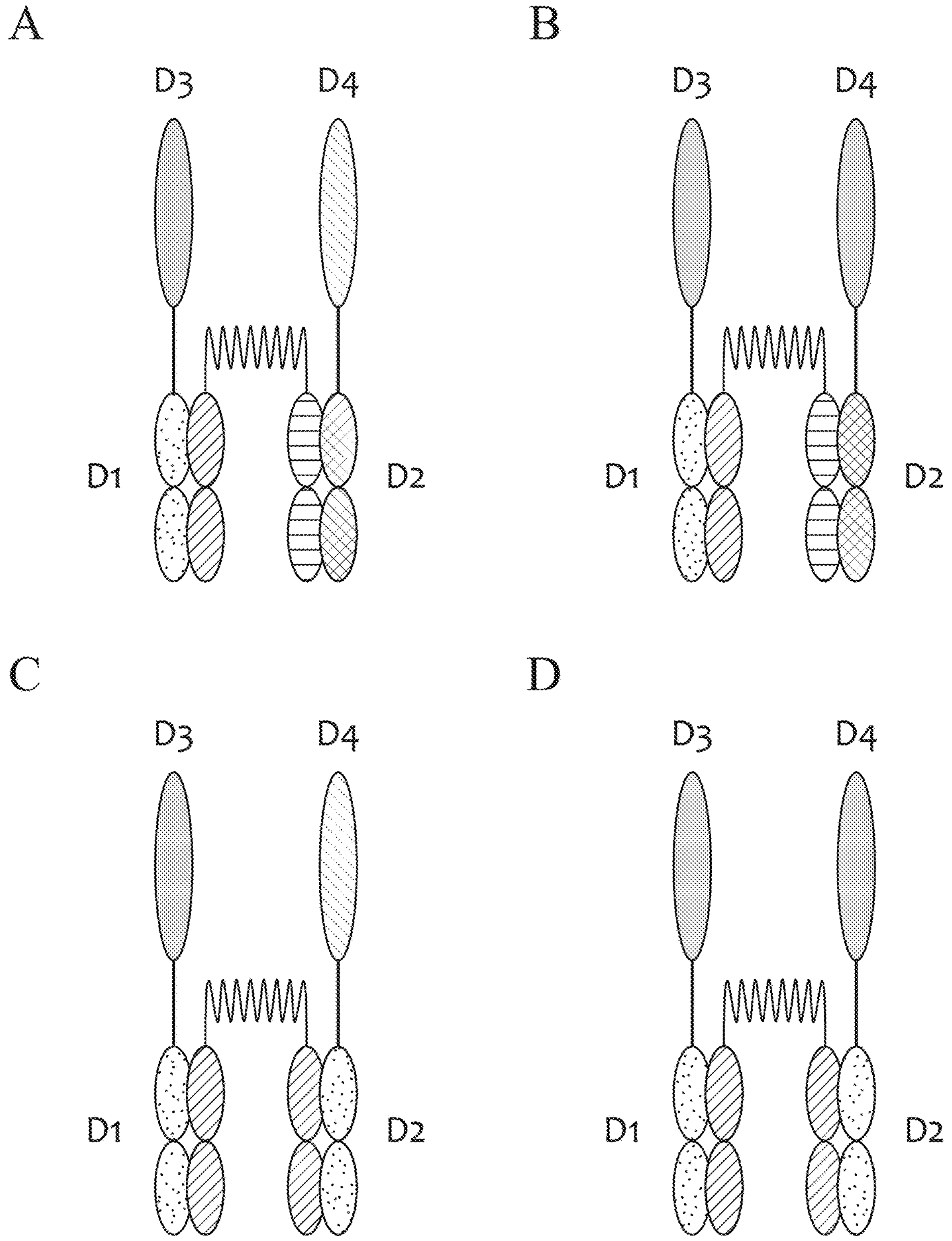
FIG. 2: Schematic structure of tetrahedral antibodies with covalent linkages shown in FIG. 1, Panel A, wherein (A) D1, D2, D3 and D4 are all different; (B) D1 and D2 are different; D3 and D4 are the same; (C) D1 and D2 are the same; D3 and D4 are different; (D) D1 and D2 are the same; D3 and D4 are the same.
Figure 11:
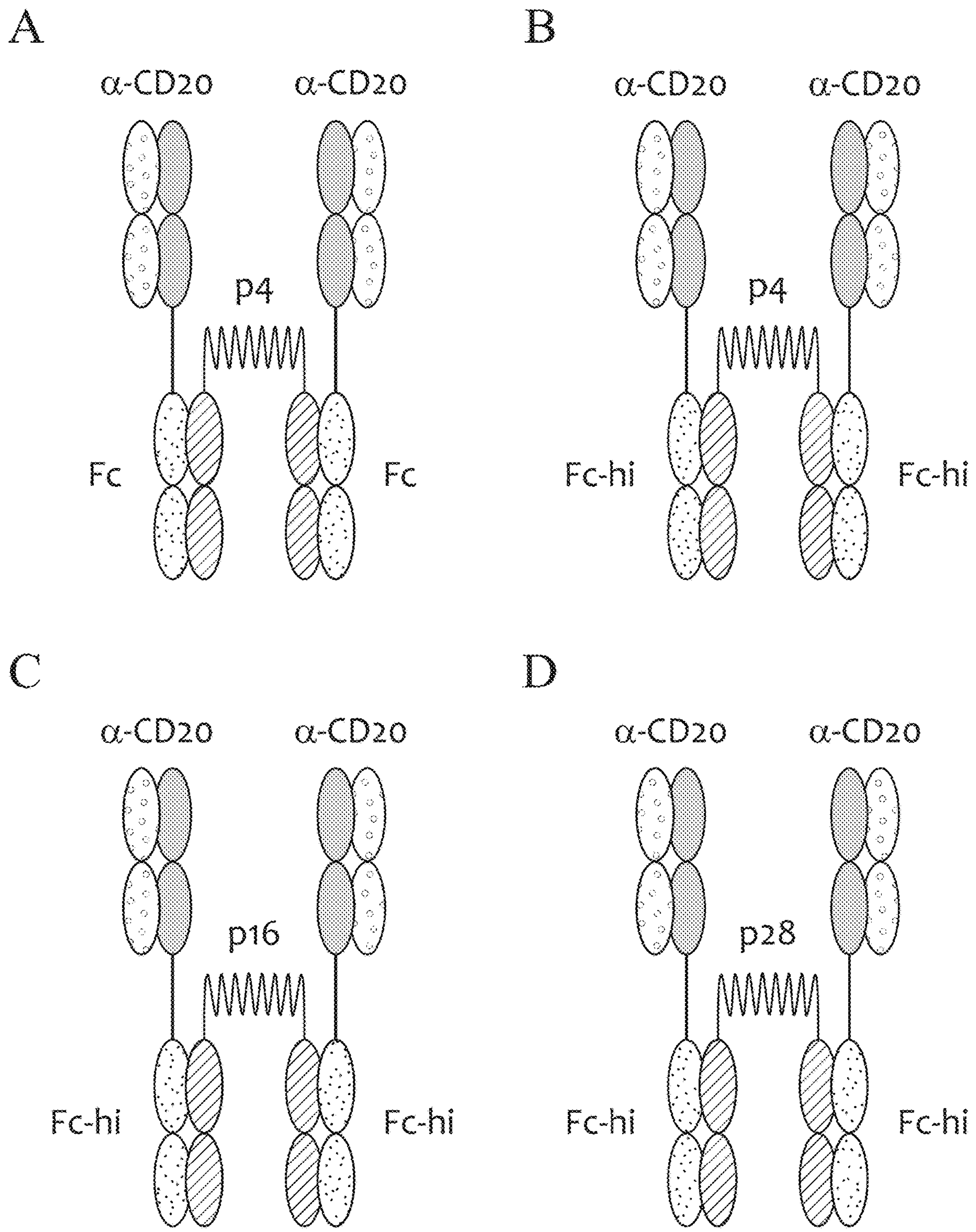
FIG. 11: Schematic structures of tetrahedral antibodies (A) Rc6-P4-Rc6, (B) Rc66SIDE-P4-Rc66SIDE, (C) Rc66SIDE-P16-Rc66SIDE, (D) Rc66SIDE-P28-Rc66SIDE, (E) B19c66-P4-Rc6m (F) Soc66-P28-6Ec66, (G) HA9c66AAC9-P4-HA9c66AAC9, and (H) HA9c66AAC9-P4-IL15c6AAC9.
Figure 11:
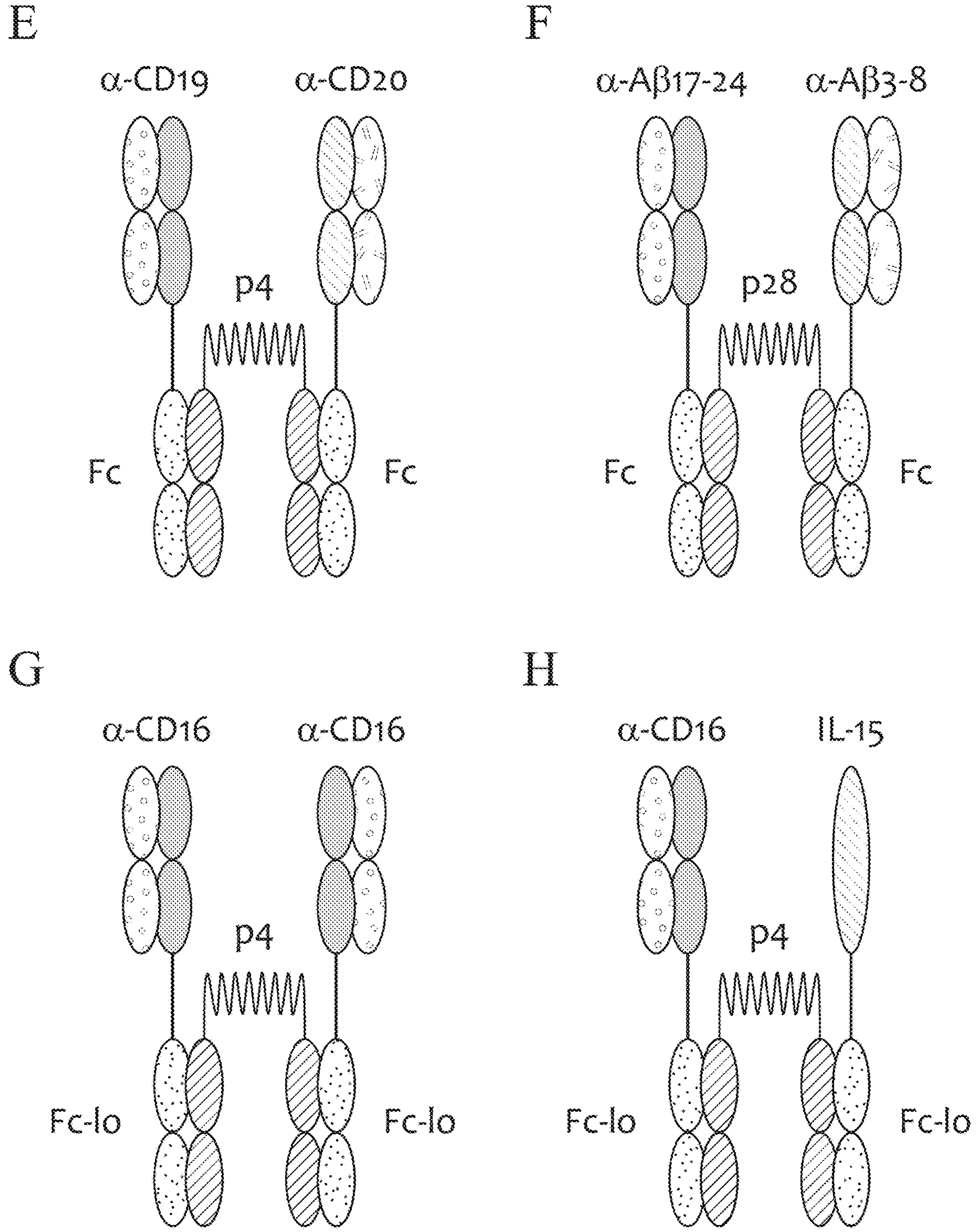
Figure 12:
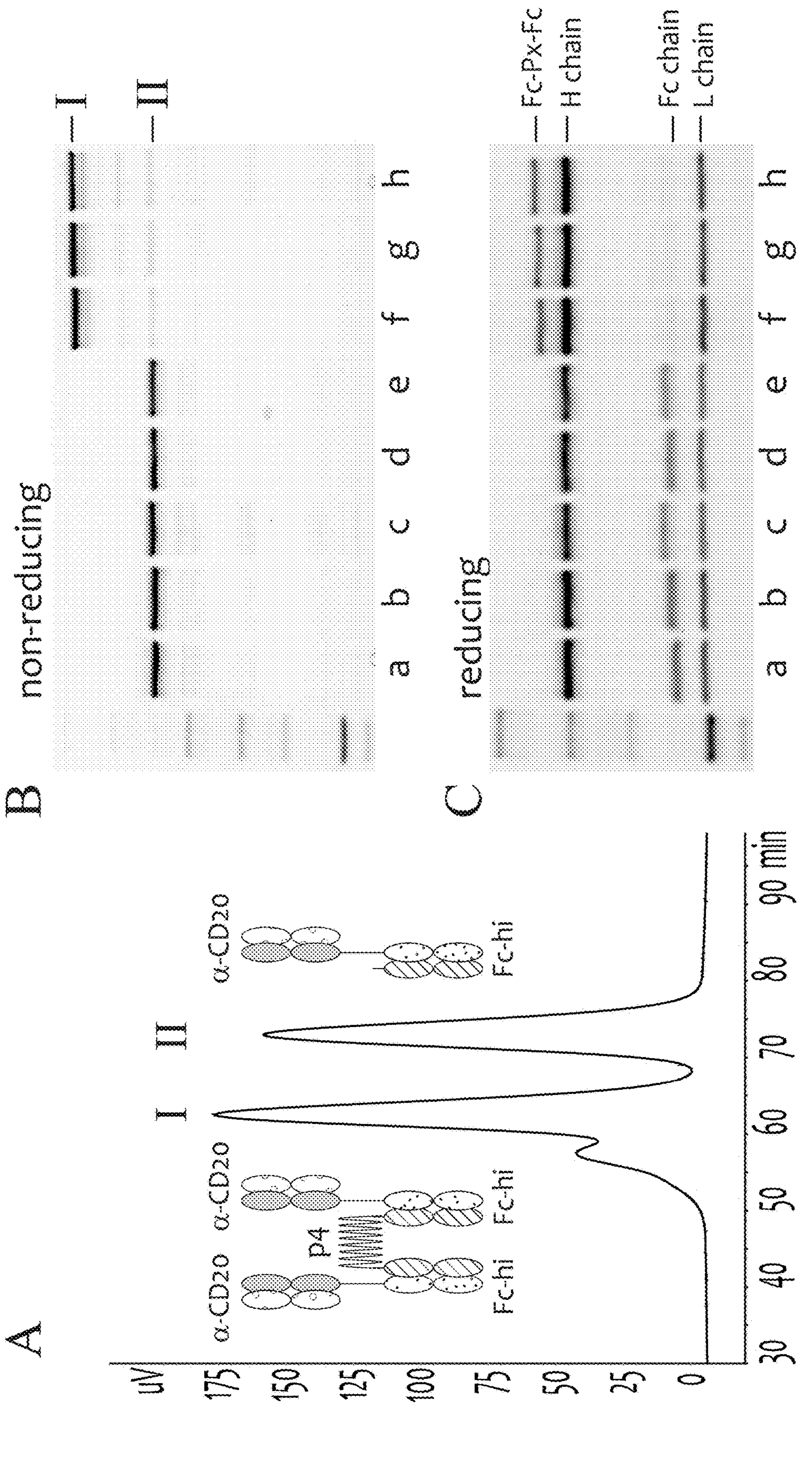
FIG. 12: Preparation of tetrahedral antibody Rc6-P4-Rc6.

Example 2—Tetrahedral Antibodies with the Structures Shown in FIG. 1 (Panel A), FIG. 2, FIG. 11 (Panels A-H), FIG. 12

Panel A of FIG. 1, FIG. 2, and panels A-H of FIG. 11 show the schematic structure of tetrahedral antibodies of this example.

FIG. 12 describes the preparation of tetrahedral antibody Rc6-P4-Rc6.

Rc6-Rc6

A tetrahedral antibody with the structure shown in FIG. 1, Panel A was constructed with the following domains:

a) Domain 1: Fc
b) Domain 2: Fc
c) Domain 3: anti-CD20Fab
d) Domain 4: anti-CD20Fab Rc6-B19

A tetrahedral antibody with the structure shown in FIG. 1, Panel A was constructed with the following domains:

a) Domain 1: Fc
b) Domain 2: Fc
c) Domain 3: anti-CD20Fab
d) Domain 4: anti-CD19Fab Rc66SIDE-Rc66SIDE A tetrahedral antibody with the structure shown in FIG. 1A was constructed with the following domains:

a) Domain 1: FcSIDE
b) Domain 2: FcSIDE
c) Domain 3: anti-CD20Fab
d) Domain 4: anti-CD20Fab

HA9AAC9-HA9AAC9

A tetrahedral antibody with the structure shown in FIG. 1, Panel A was constructed with the following domains:

a) Domain 1: FcAAC9
b) Domain 2: FcAAC9
c) Domain 3: anti-CD16Fab
d) Domain 4: anti-CD26Fab 6Ec66-Soc66

A tetrahedral antibody with the structure shown in FIG. 1, Panel A was constructed with the following domains:

a) Domain 1: Fc
b) Domain 2: Fc
c) Domain 3: anti-betaAmyloidFab
d) Domain 4: anti-betaAmyloid Fab Ace2-Ace2

A tetrahedral antibody with the structure shown in FIG. 1, Panel A was constructed with the following domains:

a) Domain 1: Fc
b) Domain 2: Fc
c) Domain 3: Ace2-615
d) Domain 4: Ace2-615

TABLE 2

SEQ IDs of Proteins Used for the Preparation of Tetrahedral Antibodies

| Protein | Light chain 1 | Light Chain 2 | Heavy chain | Fc fusion chain | Fc chain |
|---|---|---|---|---|---|
| Rc6 | SEQ ID NO 1 | | SEQ ID NO 2 | | SEQ ID NO 3 |
| Rc6HYRF | SEQ ID NO 1 | | SEQ ID NO 4 | | SEQ ID NO 3 |
| Rc60 | SEQ ID NO 1 | | SEQ ID NO 5 | | SEQ ID NO 6 |
| Rc66 | SEQ ID NO 1 | | SEQ ID NO 7 | | SEQ ID NO 8 |
| Rc66SIDE | SEQ ID NO 1 | | SEQ ID NO 9 | | SEQ ID NO 10 |
| Rc66AAC9 | SEQ ID NO 1 | | SEQ ID NO 11 | | SEQ ID NO 12 |
| HA9c66AAC9 | SEQ ID NO 16 | | SEQ ID NO 17 | | SEQ ID NO 12 |
| HRc66 | SEQ ID NO 18 | | SEQ ID NO 19 | | SEQ ID NO 8 |
| B19c66 | SEQ ID NO 20 | | SEQ ID NO 21 | | SEQ ID NO 8 |
| B19c66AAC9 | SEQ ID NO 20 | | SEQ ID NO 22 | | SEQ ID NO 12 |
| Blc6AAC9 | | | | SEQ ID NO 23 | SEQ ID NO 12 |
| Drc66 | SEQ ID NO 24 | | SEQ ID NO 25 | | SEQ ID NO 8 |
| 6Ec66 | SEQ ID NO 32 | | SEQ ID NO 33 | | SEQ ID NO 8 |
| Soc66 | SEQ ID NO 35 | | SEQ ID NO 36 | | SEQ ID NO 8 |
| IL15c6AAC9 | | | | SEQ ID NO 26 | SEQ ID NO 12 |
| IL15c6AAC9N79Q | | | | SEQ ID NO 31 | SEQ ID NO 12 |
| IL15Rc6AAC9 | | | | SEQ ID NO 27 | SEQ ID NO 12 |
| ObSpc60PG | SEQ ID NO 43 | SEQ ID NO 44 | SEQ ID NO 45 | | SEQ ID NO 42 |
| Obc60PG | SEQ ID NO 46 | | SEQ ID NO 47 | | SEQ ID NO 42 |
| ObSP41BBLc60PG | SEQ ID NO 43 | SEQ ID NO 44 | SEQ ID NO 48 | | SEQ ID NO 42 |
| Ob41BBLc60PG | SEQ ID NO 46 | | SEQ ID NO 49 | | SEQ ID NO 42 |
| ObSpc60PG41BBL-RF | SEQ ID NO 43 | SEQ ID NO 44 | SEQ ID NO 45 | | SEQ ID NO 50 |

TABLE 2-continued

SEQ IDs of Proteins Used for the Preparation of Tetrahedral Antibodies

| Protein | Light chain 1 | Light Chain 2 | Heavy chain | Fc fusion chain | Fc chain |
|---|---|---|---|---|---|
| Obc60PG41BBL-RF | SEQ ID NO 46 | | SEQ ID NO 47 | | SEQ ID NO 50 |
| GlC60PG | SEQ ID NO 38 | SEQ ID NO 39 | SEQ ID NO 40 | | SEQ ID NO 42 |
| Cic60PG | SEQ ID NO 51 | SEQ ID NO 52 | SEQ ID NO 53 | | SEQ ID NO 42 |
| ACE2RQ615c60PG | | | | SEQ ID NO 62 | SEQ ID NO 42 |
| ACE2RQ615c61PG | | | | SEQ ID NO 63 | SEQ ID NO 64 |
| ACE2RQ106c60PG | | | | SEQ ID NO 82 | SEQ ID NO 42 |
| ACE2RQ106x6c60PG | | | | SEQ ID NO 84 | SEQ ID NO 42 |
| CoV2spike680c60PG | | | | SEQ ID NO 86 | SEQ ID NO 42 |
| SARSspike666c60PG | | | | SEQ ID NO 88 | SEQ ID NO 42 |
| RaTG13spike680c60PG | | | | SEQ ID NO 89 | SEQ ID NO 42 |
| CD3Ec60PG | | | | SEQ ID NO 55 | SEQ ID NO 42 |
| 41BBc60PG | | | | SEQ ID NO 56 | SEQ ID NO 42 |
| CD19c60PG | | | | SEQ ID NO 58 | SEQ ID NO 42 |
| CEACAM5c60PG | | | | SEQ ID NO 60 | SEQ ID NO 42 |

TABLE 3

Properties of Proteins Used for the Preparation of Tetrahedral Antibodies

| Protein | D1 domain type | D1 binding specificity | D3 domain type | D3 binding specificity |
|---|---|---|---|---|
| Rc6 | Fc homodimer | FcRn, FcRγ | Fab | CD20 |
| Rc6HYRF | Fc heterodimer (HYRF) | FcRn, FcRγ (SpA-low) | Fab | CD20 |
| Rc60 | Fc heterodimer (KiH) | FcRn, FcRγ | Fab | CD20 |
| Rc66 | Fc heterodimer (ZW1) | FcRn, FcRγ | Fab | CD20 |
| Rc66SIDE | Fc heterodimer (ZW1) | FcRn, FcRγ-high | Fab | CD20 |
| Rc66AAC9 | Fc heterodimer (ZW1) | FcRn, FcRγ-low | Fab | CD20 |
| HA9c66AAC9 | Fc heterodimer (ZW1) | FcRn, FcRγ-low | Fab | CD16 |
| HRc66 | Fc heterodimer (ZW1) | FcRn, FcRγ | Fab | CD20 |
| B19c66 | Fc heterodimer (ZW1) | FcRn, FcRγ | Fab | CD19 |
| B19c66AAC9 | Fc heterodimer (ZW1) | FcRn, FcRγ-low | Fab | CD19 |
| B1c6AAC9 | Fc heterodimer (ZW1) | FcRn, FcRγ-low | ScFv-ScFv | CD19, CD3e |
| Drc66 | Fc heterodimer (ZW1) | FcRn, FcRγ | Fab | DR5 |
| 6Ec66 | Fc heterodimer (ZW1) | FcRn, FcRγ | Fab | amyloid beta (3-8) |
| Soc66 | Fc heterodimer (ZW1) | FcRn, FcRγ | Fab | amyloid beta (17-24) |
| IL15c6AAC9 | Fc heterodimer (ZW1) | FcRn, FcRγ-low | IL-15 | IL-15R alpha |
| IL15c6AAC9N79Q | Fc heterodimer (ZW1) | FcRn, FcRγ-low | IL-15 | IL-15R alpha |
| IL15Rc6AAC9 | Fc heterodimer (ZW1) | FcRn, FcRγ-low | IL-15Ra | IL-15 |
| ObSpc60PG | Fc heterodimer (KiH) | FcRn, FcRγ-low | Fab-Fab | CD20, CD3e |
| Obc60PG | Fc heterodimer (KiH) | FcRn, FcRγ-low | Fab | CD20 |
| ObSP41BBLc60PG | Fc heterodimer (KiH) | FcRn, FcRγ-low, 4-1BB | Fab-Fab | CD20, CD3e |
| Ob41BBLc60PG | Fc heterodimer (KiH) | FcRn, FcRγ-low, 4-1BB | Fab | CD20 |
| ObSpc60PG41BBL-RF | Fc heterodimer (KiH) | FcRn, FcRγ-low, 4-1BB | Fab-Fab | CD20, CD3e |
| Obc60PG41BBL-RF | Fc heterodimer (KiH) | FcRn, FcRγ-low, 4-1BB | Fab | CD20 |
| G1C60PG | Fc heterodimer (KiH) | FcRn, FcRγ-low | Fab-CrossFab(VH-VL) | CD20, CD3e |
| Cic60PG | Fc heterodimer (KiH) | FcRn, FcRγ-low | Fab-CrossFab(CHI-CL) | CEACAM5, CD3e |

TABLE 3-continued

| Properties of Proteins Used for the Preparation of Tetrahedral Antibodies | | | | |
|---|---|---|---|---|
| Protein | D1 domain type | D1 binding specificity | D3 domain type | D3 binding specificity |
| ACE2RQ615c60PG | Fc heterodimer (KiH) | FcRn, FcRγ-low | ACE2 | SARS-CoV-2 Spike protein |
| ACE2RQ615c61PG | Fc heterodimer (KiH) | FcRn, FcRγ-low | ACE2 | SARS-CoV-2 Spike protein |
| ACE2RQ106c60PG | Fc heterodimer (KiH) | FcRn, FcRγ-low | ACE2 | SARS-CoV-2 Spike protein |
| ACE2RQ106x6c60PG | Fc heterodimer (KiH) | FcRn, FcRγ-low | ACE2 | SARS-CoV-2 Spike protein |
| CoV2spike680c60PG | Fc heterodimer (KiH) | FcRn, FcRγ-low | SARS-CoV-2 Spike | ACE2 |
| SARSspike666c60PG | Fc heterodimer (KiH) | FcRn, FcRγ-low | SARS-CoV-1 Spike | ACE2 |
| RaTG13spike680c60PG | Fc heterodimer (KiH) | FcRn, FcRγ-low | RaTG13 Spike | ACE2 |
| CD3Ec60PG | Fc heterodimer (KiH) | FcRn, FcRγ-low | CD3e | anti-CD3e |
| 41BBc60PG | Fc heterodimer (KiH) | FcRn, FcRγ-low | 4-1BB | anti-4-1BB, 4-1BBL |
| CD19c60PG | Fc heterodimer (KiH) | FcRn, FcRγ-low | CD19 | anti-CD19 |
| CEACAM5c60PG | Fc heterodimer (KiH) | FcRn, FcRγ-low | CEACAM5 | anti-CEACAM5 |

TABLE 4

| Preparation of Tetrahedral Antibodies | | | | | | |
|---|---|---|---|---|---|---|
| Name | Protein 1 | Protein 2 | Crosslinker 1a | Crosslinker 1b | Crosslinker 2a | Crosslinker 2b |
| Rc6-P4-Rc6 | Rc6 | Rc6 | Az-Thioester | Tet-DBCO | TCO-P4-DBCO | Az-Thioester |
| Rc66SIDE-P4-Rc66SIDE | Rc66SIDE | Rc66SIDE | Az-Thioester | Tet-DBCO | TCO-P4-DBCO | Az-Thioester |
| Rc66SIDE-P16-Rc66SIDE | Rc66SIDE | Rc66SIDE | Az-Thioester | Tet-DBCO | TCO-P4-DBCO | Az-P12-Thioester |
| Rc66SIDE-P28-Rc66SIDE | Rc66SIDE | Rc66SIDE | Az-P12-Thioester | Tet-DBCO | TCO-P4-DBCO | Az-P12-Thioester |
| B19c66-P4-Rc6 | B19c66 | Rc6 | Az-Thioester | Tet-DBCO | TCO-P4-DBCO | Az-Thioester |
| Soc66-P28-6Ec66 | Soc66 | 6Ec66 | Az-P12-Thioester | Tet-DBCO | TCO-P4-DBCO | Az-P12-Thioester |
| HA9c66AAC9-P4-HA9c66AAC9 | HA9c66AAC9 | HA9c66AAC9 | Az-Thioester | Tet-DBCO | TCO-P4-DBCO | Az-Thioester |
| HA9c66AAC9-P4-IL15c6AAC9 | HA9c66AAC9 | IL15c6AAC9 | Az-Thioester | Tet-DBCO | TCO-P4-DBCO | Az-Thioester |
| Obc60PG-P4-Obc60PG | Obc60PG | Obc60PG | Az-Thioester | Tet-DBCO | TCO-P4-DBCO | Az-Thioester |
| Obc60PG-P4-Ob41BBc60PG | Obc60PG | Ob41BBc60PG | Az-Thioester | Tet-DBCO | TCO-P4-DBCO | Az-Thioester |
| Obc60PG-P4-Obc60PG41BB | Obc60PG | Obc60PG41BB | Az-Thioester | Tet-DBCO | TCO-P4-DBCO | Az-Thioester |
| Ob41BBc60PG-P4-Ob41BBc60PG | Ob41BBc60PG | Ob41BBc60PG | Az-Thioester | Tet-DBCO | TCO-P4-DBCO | Az-Thioester |
| Ob41BBc6OPG-P4-Obc60PG41BB | Ob41BBc60PG | Obc60PG41BB | Az-Thioester | Tet-DBCO | TCO-P4-DBCO | Az-Thioester |
| Obc60PG41BB-P4-Obc60PG41BB | Obc60PG41BB | Obc60PG41BB | Az-Thioester | Tet-DBCO | TCO-P4-DBCO | Az-Thioester |
| ObSpc60PG-P4-Obc60PG | ObSpc60PG | Obc60PG | Az-Thioester | Tet-DBCO | TCO-P4-DBCO | Az-Thioester |
| ObSpc60PG-P4-Ob41BBc60PG | ObSpc60PG | Ob41BBc60PG | Az-Thioester | Tet-DBCO | TCO-P4-DBCO | Az-Thioester |
| ObSpc60PG-P4-Obc60PG41BB | ObSpc60PG | Obc60PG41BB | Az-Thioester | Tet-DBCO | TCO-P4-DBCO | Az-Thioester |
| ObSP41BBLc60PG-P4-Ob41BBLc60PG | ObSP41BBLc60PG | Ob41BBLc60PG | Az-Thioester | Tet-DBCO | TCO-P4-DBCO | Az-Thioester |

TABLE 4-continued

| Preparation of Tetrahedral Antibodies | | | | | | |
|---|---|---|---|---|---|---|
| Name | Protein 1 | Protein 2 | Crosslinker 1a | Crosslinker 1b | Crosslinker 2a | Crosslinker 2b |
| ObSP41BBLc60PG-P4-Obc60PG41BBL | ObSP41BBLc60PG | Obc60PG41BBL | Az-Thioester | Tet-DBCO | TCO-P4-DBCO | Az-Thioester |
| ObSpc60PG41BBL-P4-Obc60PG41BBL | ObSpc60PG41BBL | Obc60PG41BBL | Az-Thioester | Tet-DBCO | TCO-P4-DBCO | Az-Thioester |
| Glc60PG-P4-Obc60PG | G1C60PG | Obc60PG | Az-Thioester | Tet-DBCO | TCO-P4-DBCO | Az-Thioester |
| Glc60PG-P4-Ob41BBc60PG | G1C60PG | Ob41BBc60PG | Az-Thioester | Tet-DBCO | TCO-P4-DBCO | Az-Thioester |
| Glc60PG-P4-Obc60PG41BB | G1C60PG | Obc60PG41BB | Az-Thioester | Tet-DBCO | TCO-P4-DBCO | Az-Thioester |
| IL15c6AAC9-P4-IL15Rc6AAC9 | IL15c6AAC9 | IL15Rc6AAC9 | Az-Thioester | Tet-DBCO | TCO-P4-DBCO | Az-Thioester |
| IL15c6AAC9-P4-Rc66AAC9 | IL15c6AAC9 | Rc66AAC9 | Az-Thioester | Tet-DBCO | TCO-P4-DBCO | Az-Thioester |
| IL15c6AAC9-P4-B19c66AAC9 | IL15c6AAC9 | B19c66AAC9 | Az-Thioester | Tet-DBCO | TCO-P4-DBCO | Az-Thioester |
| IL15c6AAC9-P4-Glc60PG | IL15c6AAC9 | G1C60PG | Az-Thioester | Tet-DBCO | TCO-P4-DBCO | Az-Thioester |
| IL15c6AAC9-P4-Cic60PG | IL15c6AAC9 | Cic60PG | Az-Thioester | Tet-DBCO | TCO-P4-DBCO | Az-Thioester |
| IL15c6AAC9-P4-Obc60PG | IL15c6AAC9 | Obc60PG | Az-Thioester | Tet-DBCO | TCO-P4-DBCO | Az-Thioester |
| IL15c6AAC9-P4-Ob41BBc60PG | IL15c6AAC9 | Ob41BBc60PG | Az-Thioester | Tet-DBCO | TCO-P4-DBCO | Az-Thioester |
| IL15c6AAC9-P4-Obc60PG41BB | IL15c6AAC9 | Obc60PG41BB | Az-Thioester | Tet-DBCO | TCO-P4-DBCO | Az-Thioester |
| IL15c6AAC9-P4-ObSpc60PG | IL15c6AAC9 | ObSpc60PG | Az-Thioester | Tet-DBCO | TCO-P4-DBCO | Az-Thioester |
| IL15c6AAC9-P4-ObSP41BBLc60PG | IL15c6AAC9 | ObSP41BBLc60PG | Az-Thioester | Tet-DBCO | TCO-P4-DBCO | Az-Thioester |
| IL15c6AAC9-P4-ObSpc60PG41BBL | IL15c6AAC9 | ObSpc60PG41BBL | Az-Thioester | Tet-DBCO | TCO-P4-DBCO | Az-Thioester |
| ACE2RQ615c60PG-P4-ACE2RQ615c60PG | ACE2RQ615c60PG | ACE2RQ615c60PG | Az-Thioester | Tet-DBCO | TCO-P4-DBCO | Az-Thioester |
| ACE2RQ615c61PG-P7-ACE2RQ615c61PG | ACE2RQ615c61PG | ACE2RQ61 5c61PG | Tet-P4-Mal | NA | Tco-P3-Mal | NA |
| ACE2RQ106c60PG-P4-ACE2RQ106c60PG | ACE2RQ106c60PG | ACE2RQ106c60PG | Az-Thioester | Tet-DBCO | TCO-P4-DBCO | Az-Thioester |
| ACE2RQ106x6c6OPG-P4-ACE2RQ106c60PG | ACE2RQ106x6c60PG | ACE2RQ106x6c60PG | Az-Thioester | Tet-DBCO | TCO-P4-DBCO | Az-Thioester |
| CoV2spike680c60PG-P4-CoV2spike680c60PG | CoV2spike680c60PG | CoV2spike680c60PG | Az-Thioester | Tet-DBCO | TCO-P4-DBCO | Az-Thioester |
| SARSspike666c6OPG-P4-SARSspike666c6OPG | SARSspike666c60PG | SARS spike666c60PG | Az-Thioester | Tet-DBCO | TCO-P4-DBCO | Az-Thioester |
| RaTG13spike680c60PG-P4-RaTG13spike680c60PG | RaTG13spike680c60PG | RaTG13spike680c60PG | Az-Thioester | Tet-DBCO | TCO-P4-DBCO | Az-Thioester |

NA, not applicable (only two crosslinkers are required)

TABLE 5

| Yields of Tetrahedral Antibodies | | | | | | | |
|---|---|---|---|---|---|---|---|
| Tetrahedral Antibody | Reactant 1 | Reactant 2 | Reactant 1 (mg) | Reactant 2 (mg) | Product (AUC) | Unreacted (AUC) | Yield % |
| Rc6-P4-Rc6 | Rc6-Tet | Rc6-P4-TCO | 3.03 | 3.10 | 885.87 | 626.26 | 58.6 |
| Rc66SIDE-P4-Rc66SIDE | Rc66SIDE-Tet | Rc66SIDE-P4-TCO | 2.15 | 2.50 | 785.13 | 674.60 | 59.9 |
| Rc66SIDE-P16-Rc66SIDE | Rc66SIDE-Tet | Rc66SIDE-P16-TCO | 2.15 | 2.50 | 675.70 | 513.68 | 56.8 |
| Rc66SIDE-P28-Rc66SIDE | Rc66SIDE-P12-Tet | Rc66SIDE-P16-TCO | 2.61 | 2.90 | 760.10 | 679.84 | 52.8 |
| B19c66-P4-Rc6 | B19c66-Tet | Rc6-P4-TCO | 4.02 | 2.87 | 913.82 | 1164.97 | 44.0 |
| Soc66-P28-6Ec66 | Soc66-P12-Tet | 6Ec66-P16-TCO | 4.96 | 3.55 | 756.17 | 2083.34 | 26.6 |
| HA9c66AAC9-P4-HA9c66AAC9 | HA9c66AAC9-Tet | HA9c66AAC9-P4-TCO | 11.52 | 8.37 | 1134.69 | 2510.24 | 31.1 |
| HA9c6AAC9-P4-IL15c6AAC9 | HA9c66AAC9-Tet | IL15c6AAC9-P4-TCO | 1.55 | 1.33 | 288.00 | 471.32 | 37.9 |

Yield (%) = (Product)/(Product + Unreacted)

TABLE 6

| Intact Mass Measurements of Tetrahedral Antibodies bv ESI-MS | | | | | | | |
|---|---|---|---|---|---|---|---|
| Control Antibody | Tetrahedral Antibody | Intact Mass (non-reducing) | L1 chain (reducing) | HI chain (reducing) | Fc chain (reducing) | Fc-Px-Fc (reducing) | Fc fusion chain (reducing) |
| Rituxan* | | 147,077.1 (147,077.0) | 23,039.3 (23,057.7) | 50,514.2 (50,530.8) | | | |
| Rc6* | | 99,815.6 (99,814.4) | 23,039.4 (23,057.7) | 50,513.9 (50,530.8) | 26,281.9 (26,281.9) | | |
| | Rc6-P4-Rc6* | 202,450.4 (202,445.2) | 23,035.9 (23.057.7) | 50,510.4 (50,530.8) | | 55,374.3 (55,380.2) | |

*The heavy and light chains undergo an N-terminal glutamine to pyroglutamate conversion (17Da decrease)

TABLE 7

| Predicted Binding Domains of Tetrahedral Antibodies | | | | |
|---|---|---|---|---|
| Tetrahedral Antibody | D1 binding specificity | D2 binding specificity | D3 binding specificity | D4 binding specificity |
| Rc6-P4-Rc6 | FcRn, FcRγ | FcRn, FcRγ | CD20 | CD20 |
| Rc66SIDE-P4-Rc66SIDE | FcRn, FcRγ-high | FcRn, FcRγ-high | CD20 | CD20 |
| Rc66SIDE-P16-Rc66SIDE | FcRn, FcRγ-high | FcRn, FcRγ-high | CD20 | CD20 |
| Rc66SIDE-P28-Rc66SIDE | FcRn, FcRγ-high | FcRn, FcRγ-high | CD20 | CD20 |
| B19c66-P4-Rc6 | FcRn, FcRγ | FcRn, FcRγ | CD19 | CD20 |
| Soc66-P28-S6Ec66 | FcRn, FcRγ | FcRn, FcRγ | amyloid beta (17-24) | amyloid beta (3-8) |
| HA9c66AAC9-P4-HA9c66AAC9 | FcRn, FcRγ-low | FcRn, FcRγ-low | CD16 | CD16 |
| HA9c66 AAC9-P4-IL15c6 AAC9 | FcRn, FcRγ-low | FcRn, FcRγ-low | CD16 | IL-15R alpha |
| Obc60PG-P4-Obc60PG | FcRn, FcRγ-low | FcRn, FcRγ-low | CD20 | CD20 |
| Obc60PG-P4-Ob41BBc60PG | FcRn, FcRγ-low | FcRn, FcRγ-low, 4-1BB | CD20 | CD20 |
| Obc60PG-P4-Obc60PG41BB | FcRn, FcRγ-low | FcRn, FcRγ-low, 4-1BB | CD20 | CD20 |
| Ob41BBc60PG-P4-Ob41BBc60PG | FcRn, FcRγ-low, 4-1BB | FcRn, FcRγ-low, 4-1BB | CD20 | CD20 |
| Ob41BBc60PG-P4-Obc60PG41BB | FcRn, FcRγ-low, 4-1BB | FcRn, FcRγ-low, 4-1BB | CD20 | CD20 |
| Obc60PG41BB-P4-Obc60PG41BB | FcRn, FcRγ-low, 4-1BB | FcRn, FcRγ-low, 4-1BB | CD20 | CD20 |
| ObSpc60PG-P4-Obc60PG | FcRn, FcRγ-low | FcRn, FcRγ-low | CD20, CD3 | CD20 |
| ObSpc60PG-P4-Ob41BBc60PG | FcRn, FcRγ-low | FcRn, FcRγ-low, 4-1BB | CD20, CD3 | CD20 |
| ObSpc60PG-P4-Obc60PG41BB | FcRn, FcRγ-low | FcRn, FcRγ-low, 4-1BB | CD20, CD3 | CD20 |

TABLE 7-continued

Predicted Binding Domains of Tetrahedral Antibodies

| Tetrahedral Antibody | D1 binding specificity | D2 binding specificity | D3 binding specificity | D4 binding specificity |
|---|---|---|---|---|
| ObSP41BBLc60PG-P4-Ob41BBLc60PG | FcRn, FcRγ-low, 4-1BB | FcRn, FcRγ-low, 4-1BB | CD20, CD3 | CD20 |
| ObSP41BBLc60PG-P4-Obc60PG41BBL | FcRn, FcRγ-low, 4-1BB | FcRn, FcRγ-low, 4-1BB | CD20, CD3 | CD20 |
| ObSpc60PG41BBL-P4-Obc60PG41BBL | FcRn, FcRγ-low, 4-1BB | FcRn, FcRγ-low, 4-1BB | CD20, CD3 | CD20 |
| Glc60PG-P4-Obc60PG | FcRn, FcRγ-low | FcRn, FcRγ-low | CD20, CD3 | CD20 |
| Glc60PG-P4-Ob41BBc60PG | FcRn, FcRγ-low | FcRn, FcRγ-low, 4-1BB | CD20, CD3 | CD20 |
| Glc60PG-P4-Obc60PG41BB | FcRn, FcRγ-low | FcRn, FcRγ-low, 4-1BB | CD20, CD3 | CD20 |
| IL15c6AAC9-P4-IL15Rc6AAC9 | FcRn, FcRγ-low | FcRn, FcRγ-low | IL-15R alpha | IL-15 |
| IL15c6AAC9-P4-Rc66AAC9 | FcRn, FcRγ-low | FcRn, FcRγ-low | IL-15R alpha | CD20 |
| IL15c6AAC9-P4-B19c66AAC9 | FcRn, FcRγ-low | FcRn, FcRγ-low | IL-15R alpha | CD19 |
| IL15c6AAC9-P4-Obc60PG | FcRn, FcRγ-low | FcRn, FcRγ-low | IL-15R alpha | CD20 |
| IL15c6AAC9-P4-Ob41BBc60PG | FcRn, FcRγ-low | FcRn, FcRγ-low, 4-1BB | IL-15R alpha | CD20 |
| IL15c6AAC9-P4-Obc60PG41BB | FcRn, FcRγ-low | FcRn, FcRγ-low, 4-1BB | IL-15R alpha | CD20 |
| IL15c6AAC9-P4-ObSpc60PG | FcRn, FcRγ-low | FcRn, FcRγ-low | IL-15R alpha | CD20, CD3 |
| IL15c6AAC9-P4-ObSP41BBLc60PG | FcRn, FcRγ-low | FcRn, FcRγ-low, 4-1BB | IL-15R alpha | CD20, CD3 |
| IL15c6AAC9-P4-ObSpc60PG41BBL | FcRn, FcRγ-low | FcRn, FcRγ-low, 4-1BB | IL-15R alpha | CD20, CD3 |
| IL15c6AAC9-P4-Glc60PG | FcRn, FcRγ-low | FcRn, FcRγ-low | IL-15R alpha | CD20, CD3 |
| IL15c6 AAC9-P4-Cic60PG | FcRn, FcRγ-low | FcRn, FcRγ-low | IL-15R alpha | CEACAM5, CD3 |
| ACE2RQ615c60PG-P4-ACE2RQ615c60PG | FcRn, FcRγ-low | FcRn, FcRγ-low | SARS-CoV-2 S protein | SARS-CoV-2 S protein |
| ACE2RQ615c61PG-P7-ACE2RQ615c61PG | FcRn, FcRγ-low | FcRn, FcRγ-low | SARS-CoV-2 S protein | SARS-CoV-2 S protein |
| ACE2RQ106c60PG-P4-ACE2RQ106c60PG | FcRn, FcRγ-low | FcRn, FcRγ-low | SARS-CoV-2 S protein | SARS-CoV-2 S protein |
| ACE2RQ106x6c60PG-P4-ACE2RQ106c60PG | FcRn, FcRγ-low | FcRn, FcRγ-low | SARS-CoV-2 S protein | SARS-CoV-2 S protein |
| CoV2spike680c60PG-P4-CoV2spike680c60PG | FcRn, FcRγ-low | FcRn, FcRγ-low | ACE2 | ACE2 |
| SARSspike666c60PG-P4-SARSspike666c60PG | FcRn, FcRγ-low | FcRn, FcRγ-low | ACE2 | ACE2 |
| RaTG13 spike680c60PG-P4-RaTG13spike680c60PG | FcRn, FcRγ-low | FcRn, FcRγ-low | ACE2 | ACE2 |

TABLE 8

Observed IgG-FcRγ Binding of Tetrahedral Antibodies

| Tetrahedral Antibody | Control Antibody | CD16a 158F FcRγIIIa | CD16a 158V FcRγIIIa | CD16b FcRγIIIb | CD32a 131H FcRγIIa | CD32a 131R FcRγIIa | CD32b/c FcRγIIb | CD64 FcRγI |
|---|---|---|---|---|---|---|---|---|
| | Rituxan (antibody) | 1.10E−06 (1.0) | 7.15E−07 (1.0) | 1.53E−06 (1.0) | 8.92E−07 (1.0) | 1.25E−06 (1.0) | 1.52E−06 (1.0) | 5.28E−08 (1.0) |
| | Rituximab-SIDE (antibody) | 1.18E−07 (9.3) | 6.08E−08 (11.8) | 1.94E−07 (7.9) | 4.45E−07 (2.0) | 3.88E−07 (3.2) | 4.52E−07 (3.3) | 9.41E−09 (5.6) |
| | Rc66SIDE (One-arm antibody) | 7.68E−08 (14.3) | 4.62E−08 (15.5) | 1.63E−07 (9.4) | 2.55E−07 (3.5) | 2.02E−07 (6.2) | 2.53E−07 (6.0) | 1.20E−08 (4.4) |
| Rc66SIDE-P4-Rc66SIDE | | 3.87E−09 (283.8) | 1.14E−09 (628.9) | 1.05E−09 (1456.1) | 2.54E−09 (351.3) | 4.93E−09 (252.9) | 3.17E−09 (478.5) | <1.0E−12 (>10,000) |
| Rc66SIDE-P16-Rc66SIDE | | 2.71E−09 (405.6) | 2.57E−10 (2785.7) | <1.0E−12 (>10,000) | 8.08E−10 (1103.3) | 1.83E−09 (682.0) | 5.56E−10 (2727.3) | <1.0E−12 (>10,000) |
| Rc66SIDE-P28-Rc66SIDE | | 6.62E−09 (166.0) | 4.98E−09 (143.7) | 5.64E−09 (270.7) | 5.42E−09 (164.4) | 8.11E−09 (153.7) | 7.28E−09 (208.1) | 1.14E−09 (46.3) |

TABLE 9

Observed Binding by Tetrahedral Antibodies to CD20, CD10 and CD16a

| Tetrahedral Antibody | Control Antibody | CD20 Lipoparticles Expt #1 | CD20 Lipoparticles Expt #2 | CD19 | CD16a 158V FcRγIIIa |
|---|---|---|---|---|---|
| | Rituxan (antibody) | <1.0E−12 | <1.0E−12 | No binding | 2.62E−07 |
| | Rc6 (one-arm antibody) | 5.23E−08 | 1.71E−08 | No binding | 3.03E−07 |
| | Rc66-SIDE (one-arm antibody) | 2.14E−08 | ND | ND | ND |
| Rc6-P4-Rc6 | | <1.0E−12 | ND | ND | ND |
| Rc66SIDE-P4-Rc66SIDE | | <1.0E−12 | ND | ND | ND |
| Rc66SIDE-P16-Rc66SIDE | | <1.0E−12 | ND | ND | ND |
| Rc66SIDE-P28-Rc66SIDE | | <1.0E−12 | ND | ND | ND |
| | B19c66 (one-arm antibody) | No binding | No binding | 2.18E−08 | 2.34E−07 |
| | B19c66AAC9 (one-arm antibody | ND | ND | 2.10E−08 | No binding |
| B19c66-P4-Rc6 | | ND | 3.99E−08 | 1.81E−08 | 2.45E−08 |

ND, not done

Figure 3:
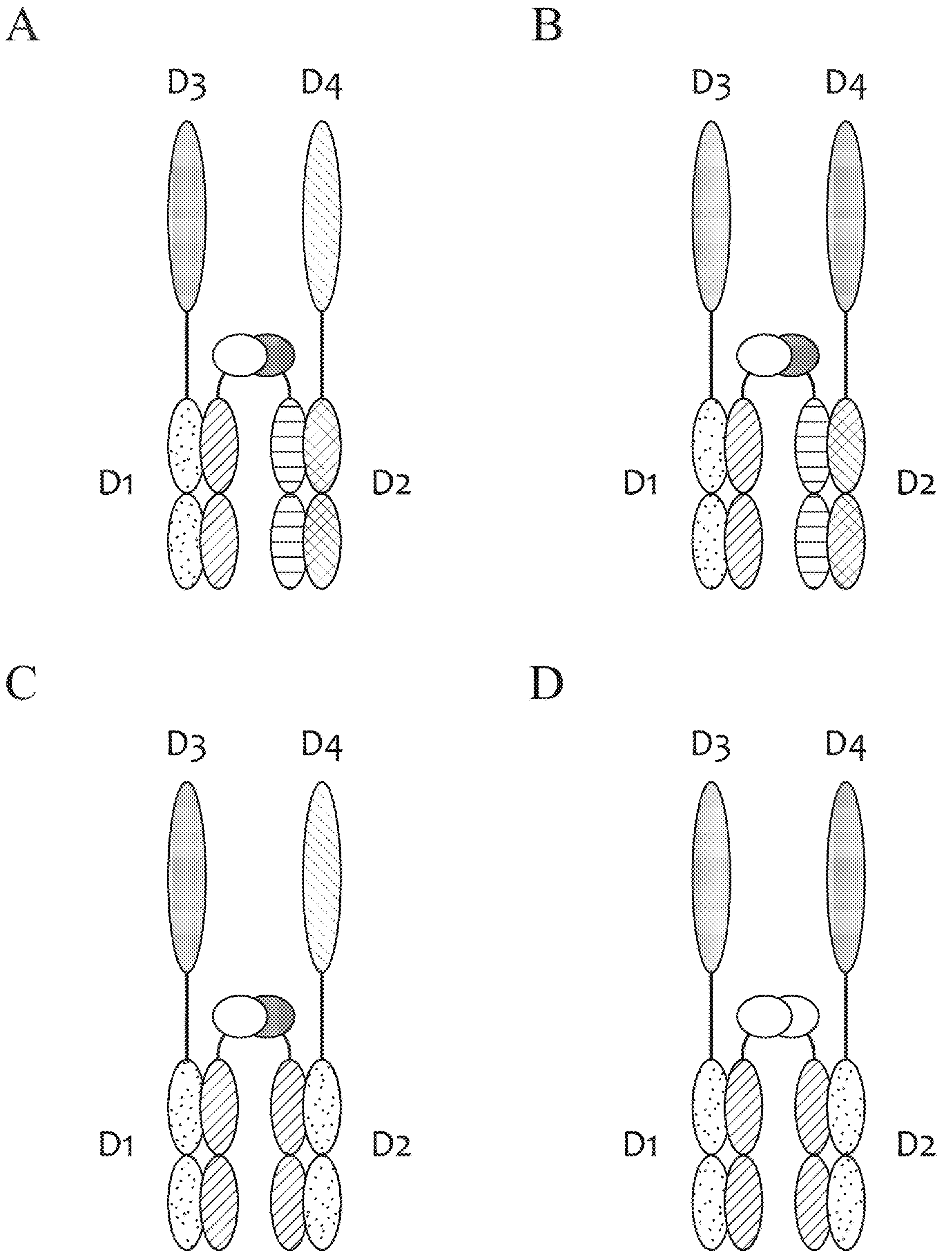
FIG. 3: Schematic structure of tetrahedral antibodies with non-covalent linkages shown in FIG. 1, Panel B, wherein (A) D1, D2, D3 and D4 are all different; (B) D1 and D2 are different; D3 and D4 are the same; (C) D1 and D2 are the same; D3 and D4 are different; (D) D1 and D2 are the same; D3 and D4 are the same. A single pair of dimerizing polypeptides form a heterodimeric pair in (A-C), and a homodimeric pair in (D).
Figure 13:
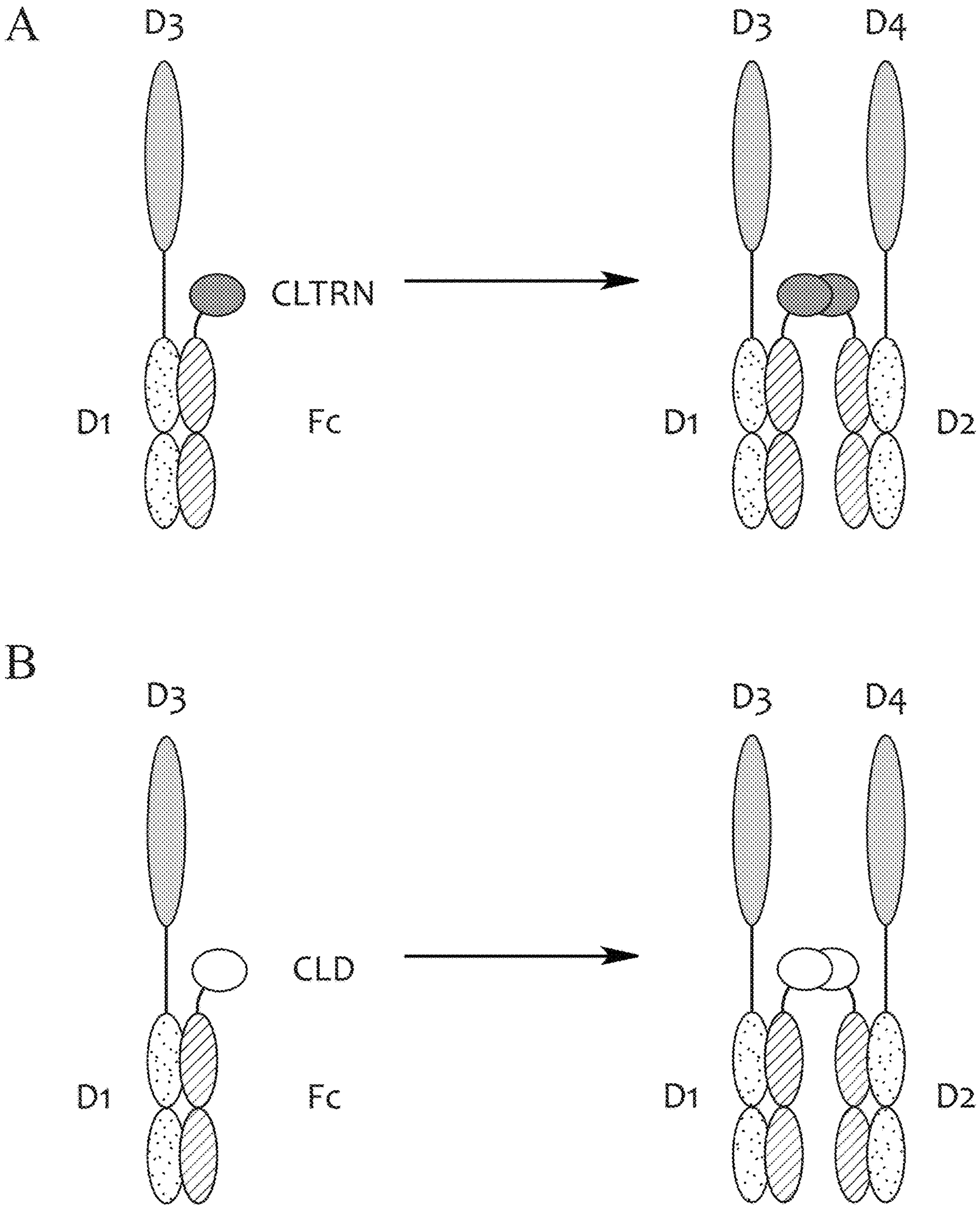
FIG. 13: Preparation of tetrahedral antibodies with non-covalent linkages as shown in Panel B of FIG. 1.

Example 3—Tetrahedral Antibodies with the Structures Shown in Panel B of FIG. 1, FIG. 3, and FIG. 13

Panel B of FIG. 1 and FIG. 3 show the schematic structure of tetrahedral antibodies of this example.

FIG. 13 describes the preparation of tetrahedral antibodies with non-covalent linkages as shown in Panel B of FIG. 1.

Example 4—Tetrahedral Antibodies with the Structures Shown in Panel C of FIG. 1, FIG. 4, and FIG. 14-18

Figure 4:
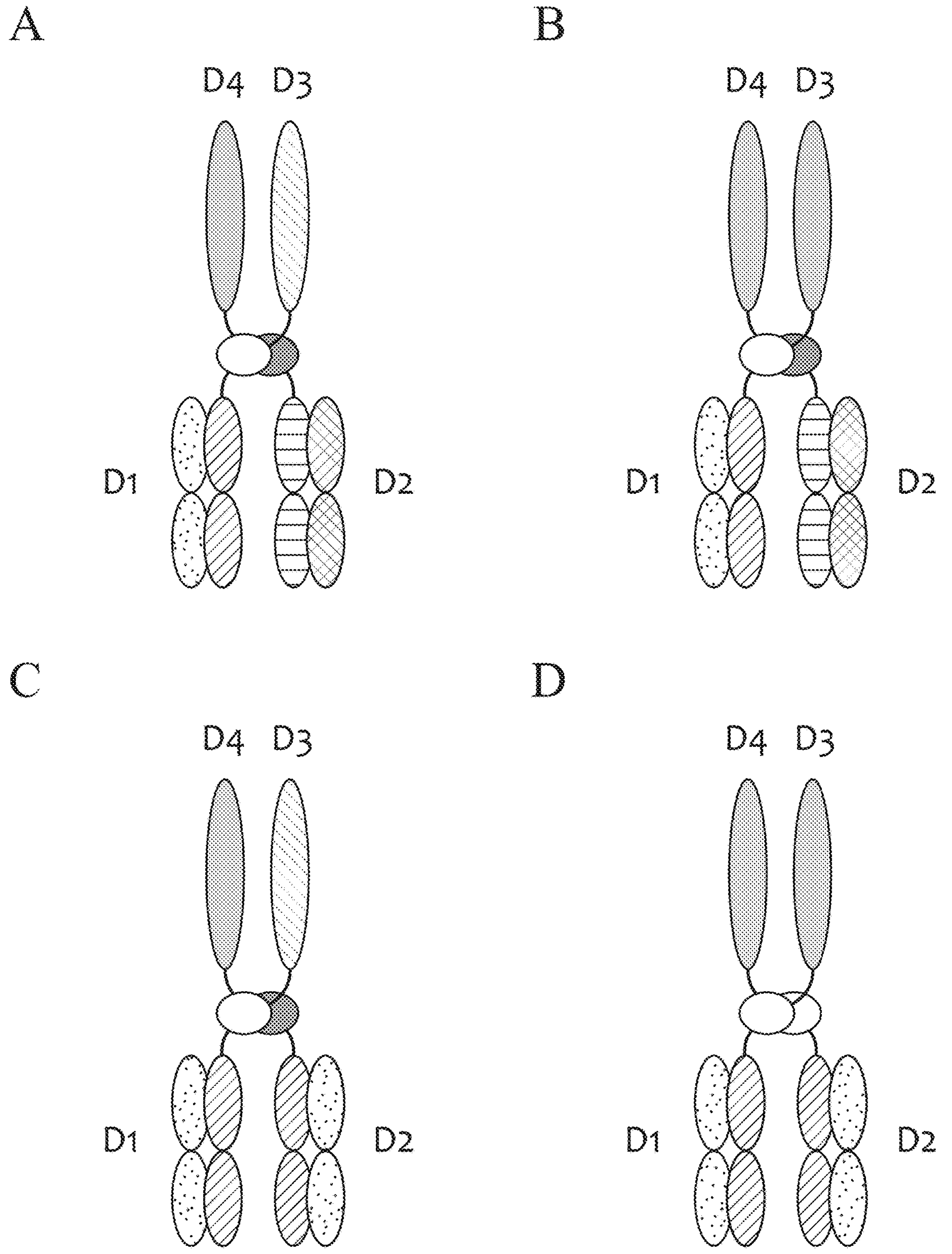
FIG. 4: Schematic structure of tetrahedral antibodies with non-covalent linkages shown in FIG. 1, Panel C, wherein (A) D1, D2, D3 and D4 are all different; (B) D1 and D2 are different; D3 and D4 are the same; (C) D1 and D2 are the same; D3 and D4 are different; (D) D1 and D2 are the same; D3 and D4 are the same. A single pair of dimerizing polypeptides form a heterodimeric pair in (A-C), and a homodimeric pair in (D).
Figure 5:
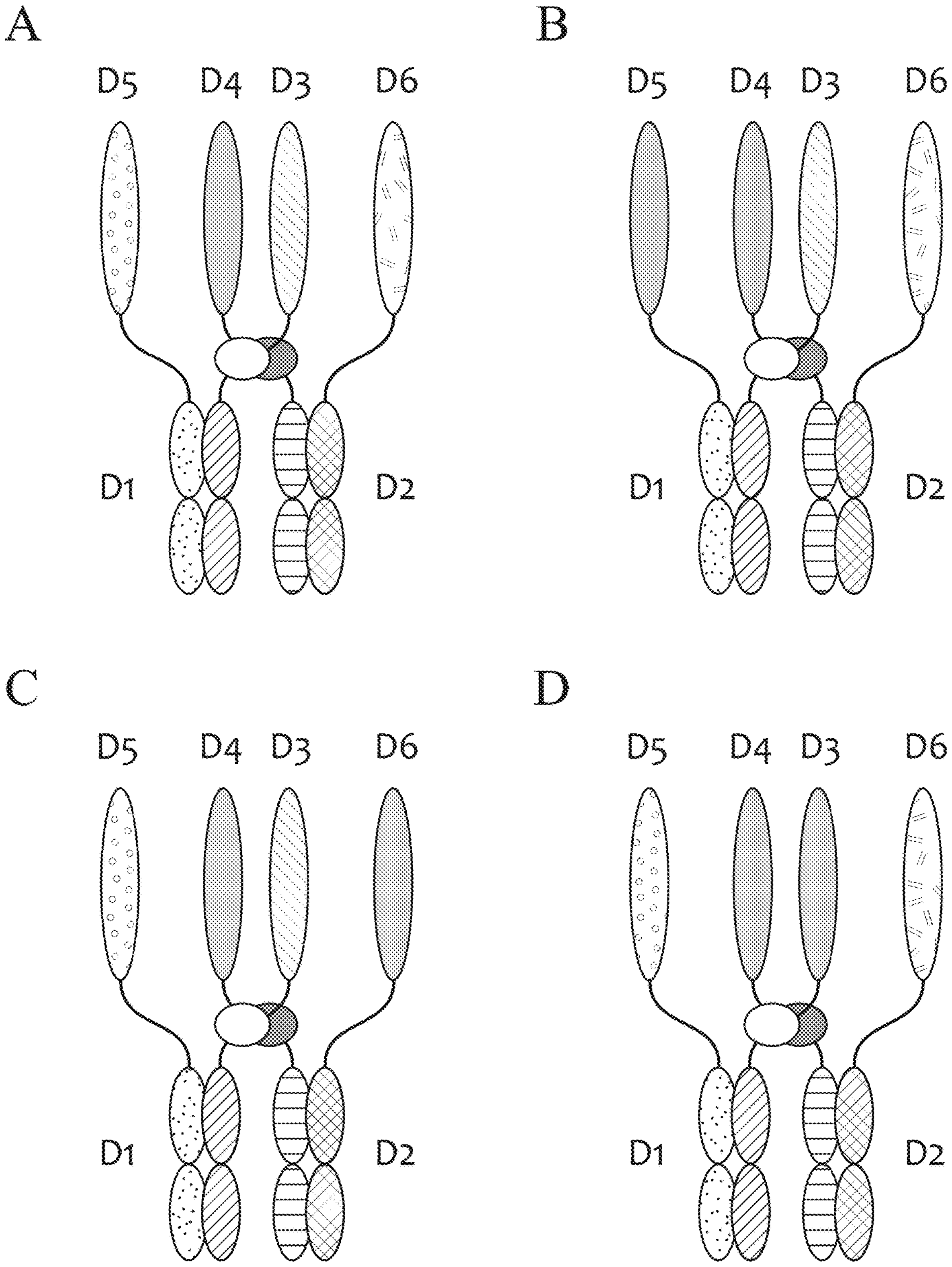
FIG. 5: Schematic structure of tetrahedral antibodies with non-covalent linkages shown in FIG. 1, Panel D, wherein D1 and D2 are different, and wherein among the D3-D6 domains (A) D3-D6 are all different; (B) D4 and D5 are the same and D3 and D6 are different; (C) D4 and D6 are the same and D3 and D5 are different; (D) D3 and D4 are the same and D5 and D6 are different. A single pair of dimerizing polypeptides form a heterodimeric pair in (A-D).
Figure 6:
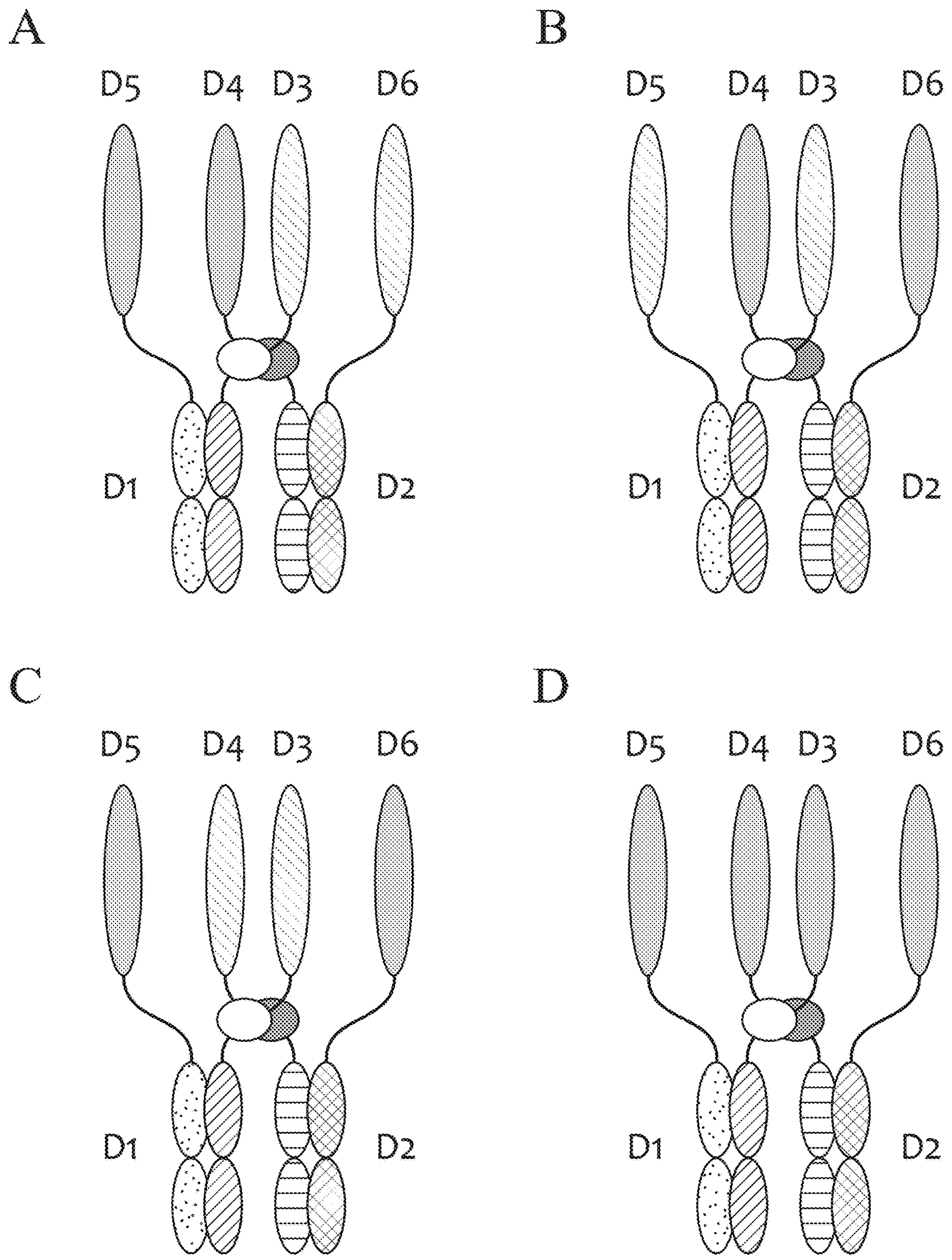
FIG. 6: Schematic structure of tetrahedral antibodies with non-covalent linkages shown in FIG. 1, Panel D, wherein D1 and D2 are different, and wherein among the D3-D6 domains (A) D3 and D6 are the same, and D4 and D6 are the same; (B) D3 and D5 are the same, and D4 and D5 are the same; (C) D3 and D4 are the same, and D5 and D6 are the same; (D) D3-D6 are the same. A single pair of dimerizing polypeptides form a heterodimeric pair in (A-D).
Figure 7:
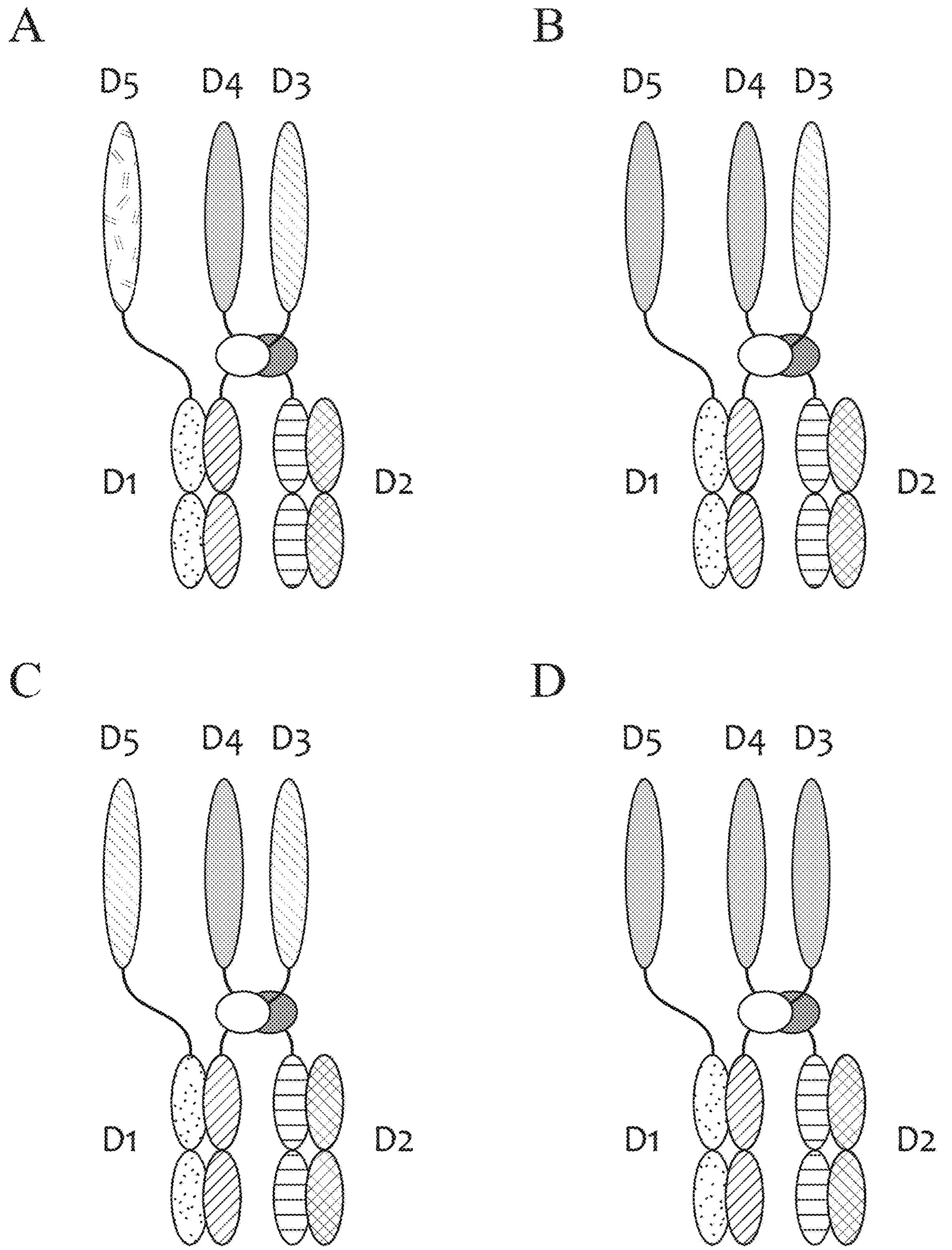
FIG. 7: Schematic structure of tetrahedral antibodies with non-covalent linkages shown in FIG. 1, Panel D, wherein D1 and D2 are different, there is no D6 domain, and wherein among the D3-D5 domains (A) D3-D5 are all different; (B) D4 and D5 are the same, and D3 is different; (C) D3 and D5 are the same, and D4 is different; (D) D3-D5 are all the same. A single pair of dimerizing polypeptides form a heterodimeric pair in (A-D).
Figure 8A:
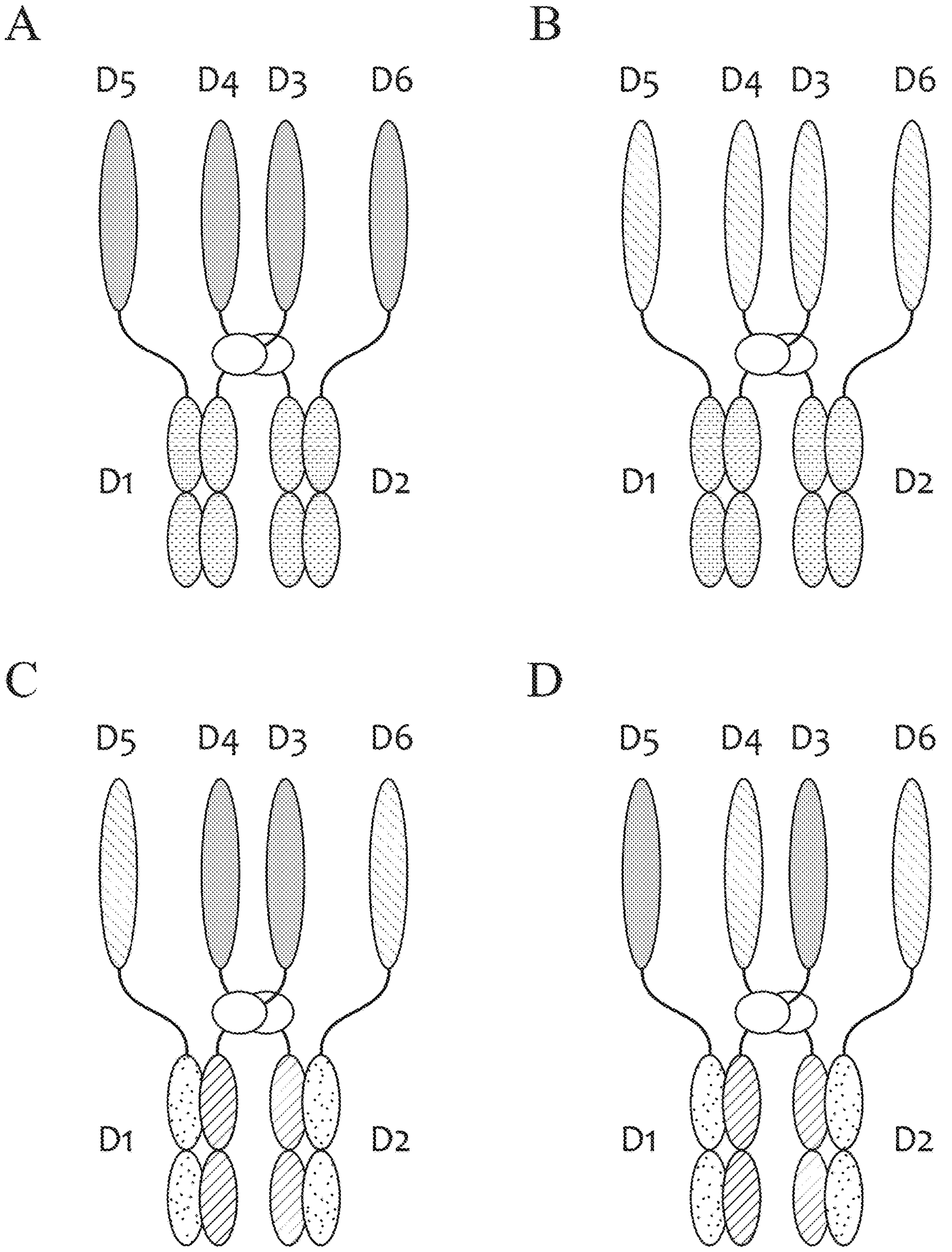
FIG. 8A: Schematic structure of tetrahedral antibodies with non-covalent linkages shown in FIG. 1, Panel D, wherein D1 and D2 are the same, and wherein among the D3-D6 domains (A) D3-D6 are all the same of a first type; (B) D3-D6 are all the same of a second type; (C) D3 and D4 are of the first type and D5 and D6 are of the second type, (D) D3 and D5 are of the first type and D4 and D6 are of the second type. A single pair of dimerizing polypeptides form a homodimeric pair in (A-D).
Figure 8B:
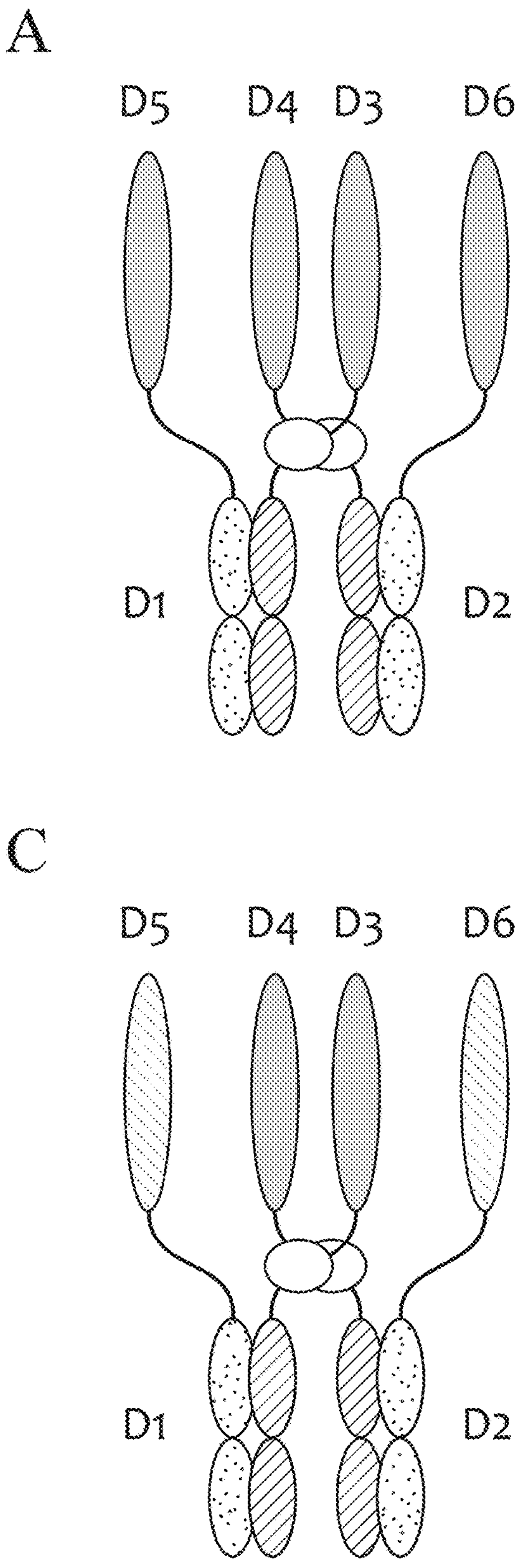
FIG. 8B: Schematic structure of tetrahedral antibodies with non-covalent linkages shown in FIG. 1, Panel D, wherein D1 and D2 are the same, and wherein among the D3-D6 domains (A) D3-D6 are all the same of a first type; (B) D3-D6 are all the same of a second type; (C) D3 and D4 are of the first type and D5 and D6 are of the second type, (D) D3 and D4 are of the second type and D5 and D6 are of the first type. A single pair of dimerizing polypeptides form a homodimeric pair in (A-D).
Figure 9:
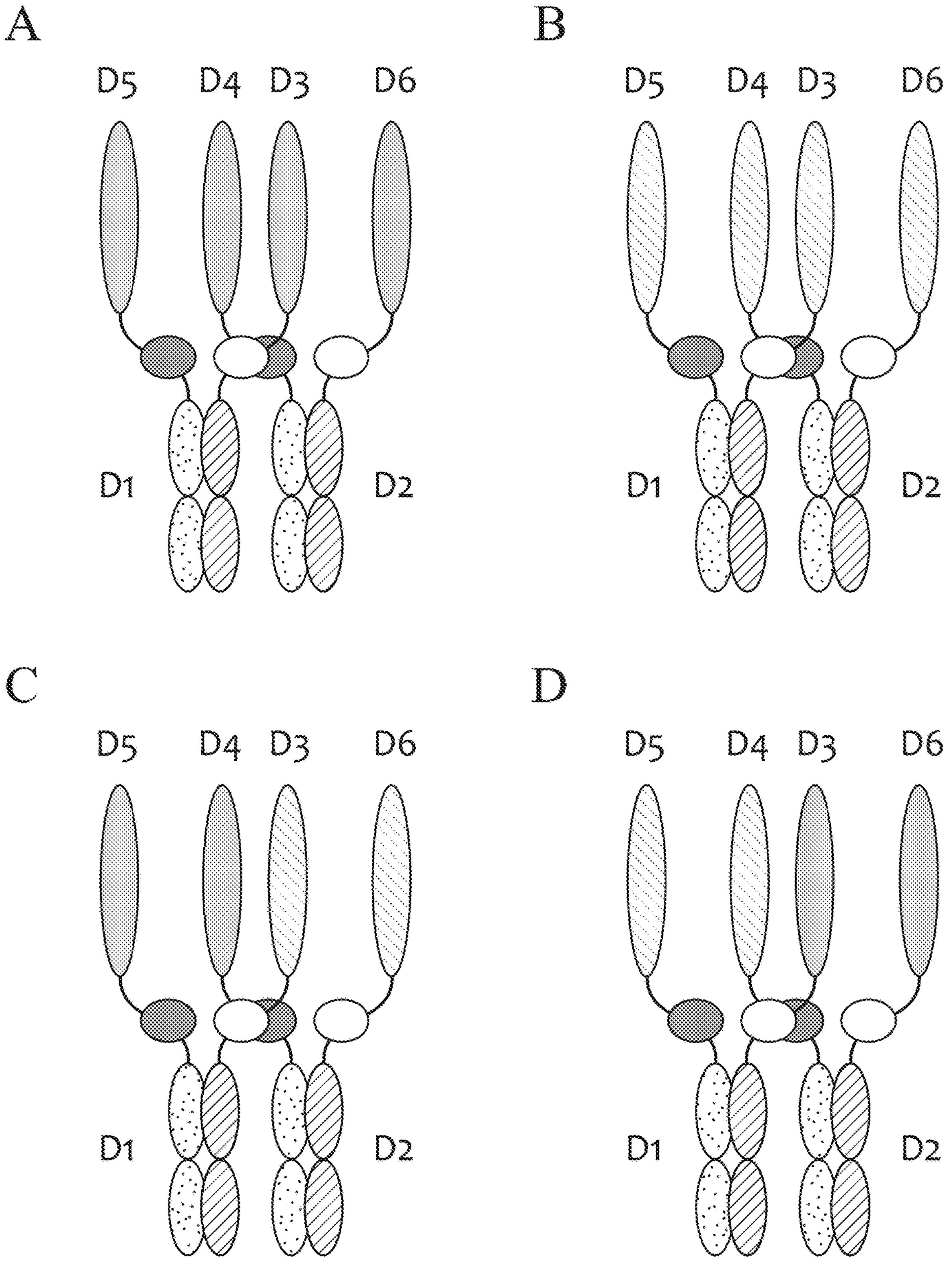
FIG. 9: Schematic structure of tetrahedral antibodies with non-covalent linkages shown in FIG. 1, Panel D, wherein D1 and D2 are the same, and wherein among the D3-D5 domains (A) D3-D6 are all the same of a first type, and (B) D3-D6 are all the same of a second type; (C) D4 and D5 are of the first type and D3 and D6 are of the second type, (D) D3 and D6 are of the first type and D4 and D5 are of the second type. Each of two pairs of dimerizing polypeptides form a heterodimeric pair in (A-D).
Figure 10:
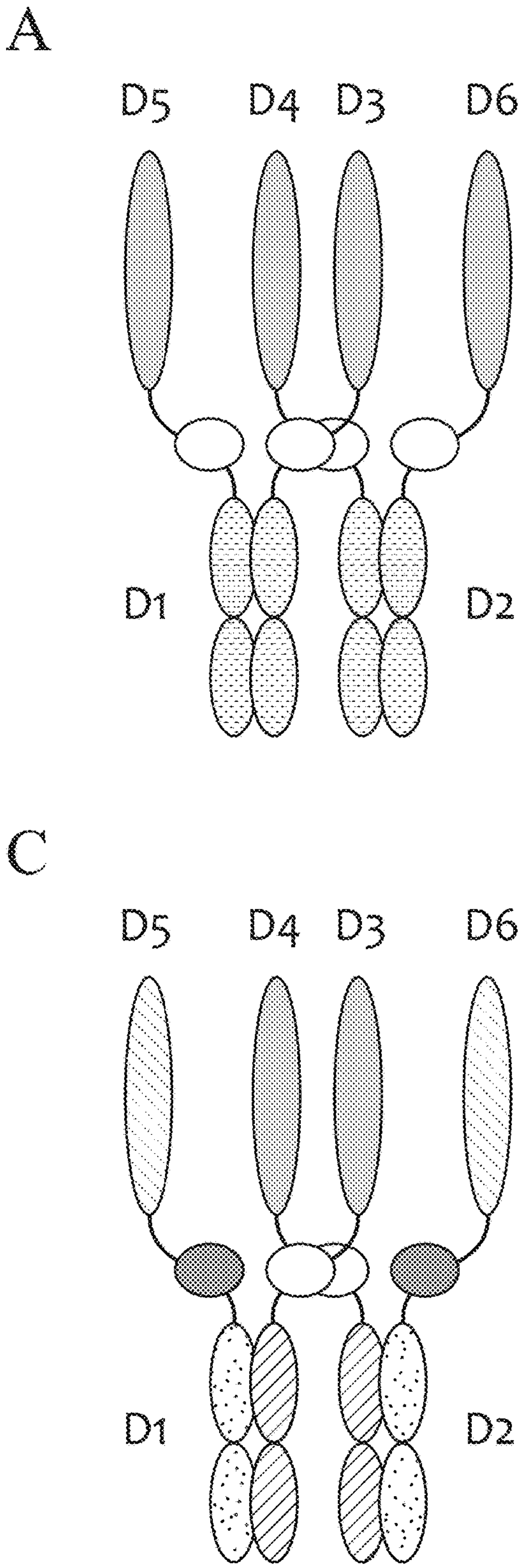
FIG. 10: Schematic structure of tetrahedral antibodies with non-covalent linkages shown in FIG. 1, Panel D, (A-B) wherein D1 and D2 are the same, and wherein among the D3-D5 domains (A) D3-D6 are all the same of a first type, and (B) D3-D6 are all the same of a second type; (C-D) wherein D1 and D2 are different, and wherein among the D3-D5 domains (C) D3 and D4 are of the first type and D5 and D6 are of the second type, (D) D3 and D5 are of the first type and D4 and D6 are of the second type. Each of two pairs of dimerizing polypeptides form a homodimeric pair in (A-B). Each of two distinct pairs of dimerizing polypeptides form separate homodimeric pairs in (C-D).

Panel C of Figure C and FIG. 4 show the schematic structure of tetrahedral antibodies of this example.

Figure 14:
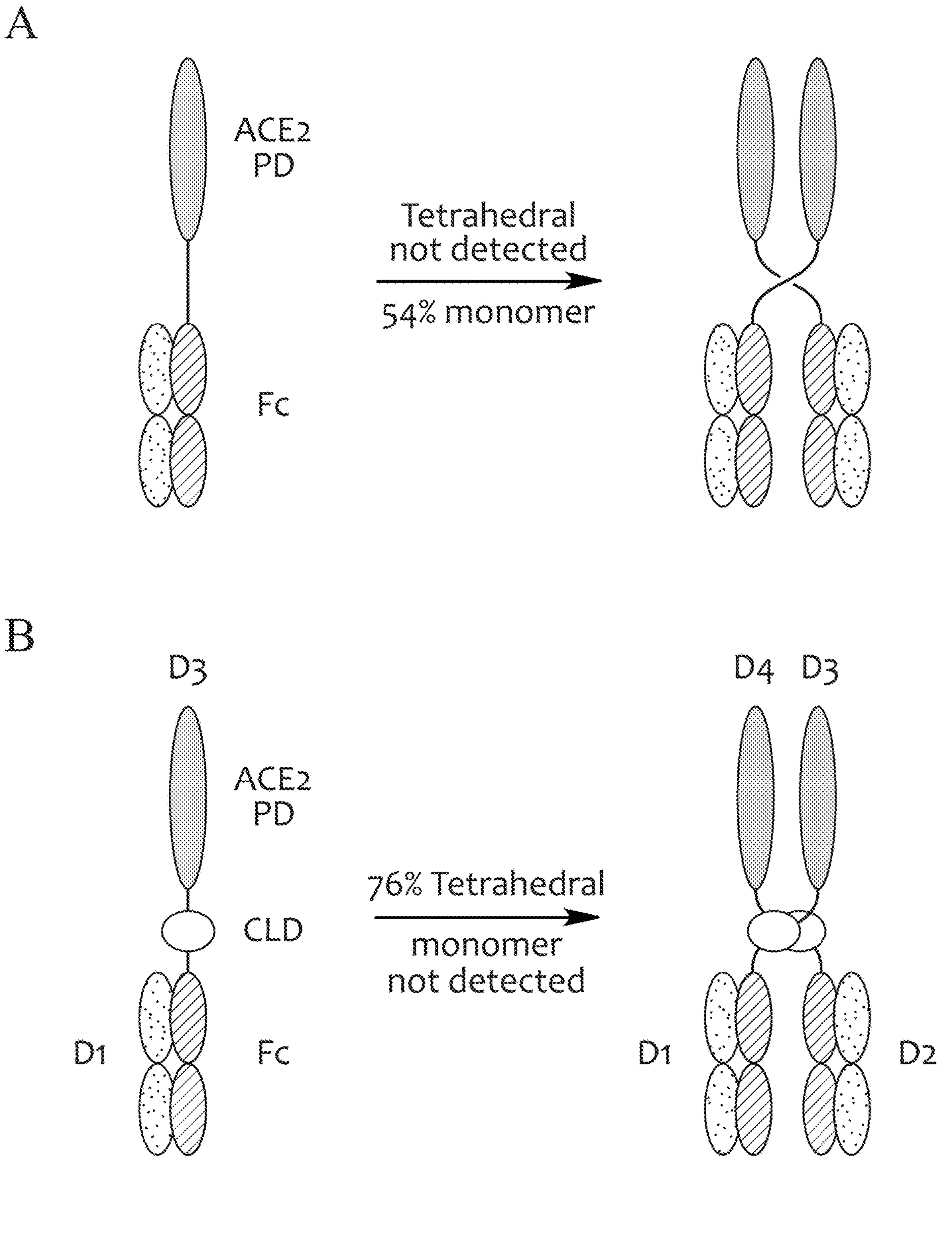
FIG. 14: Preparation of tetrahedral antibody ACE2RQ740c60PG-ACE2RQ740c60PG.

FIG. 14 describes the preparation of tetrahedral antibody ACE2RQ740c60PG-ACE2RQ740c60PG.

Figure 15:
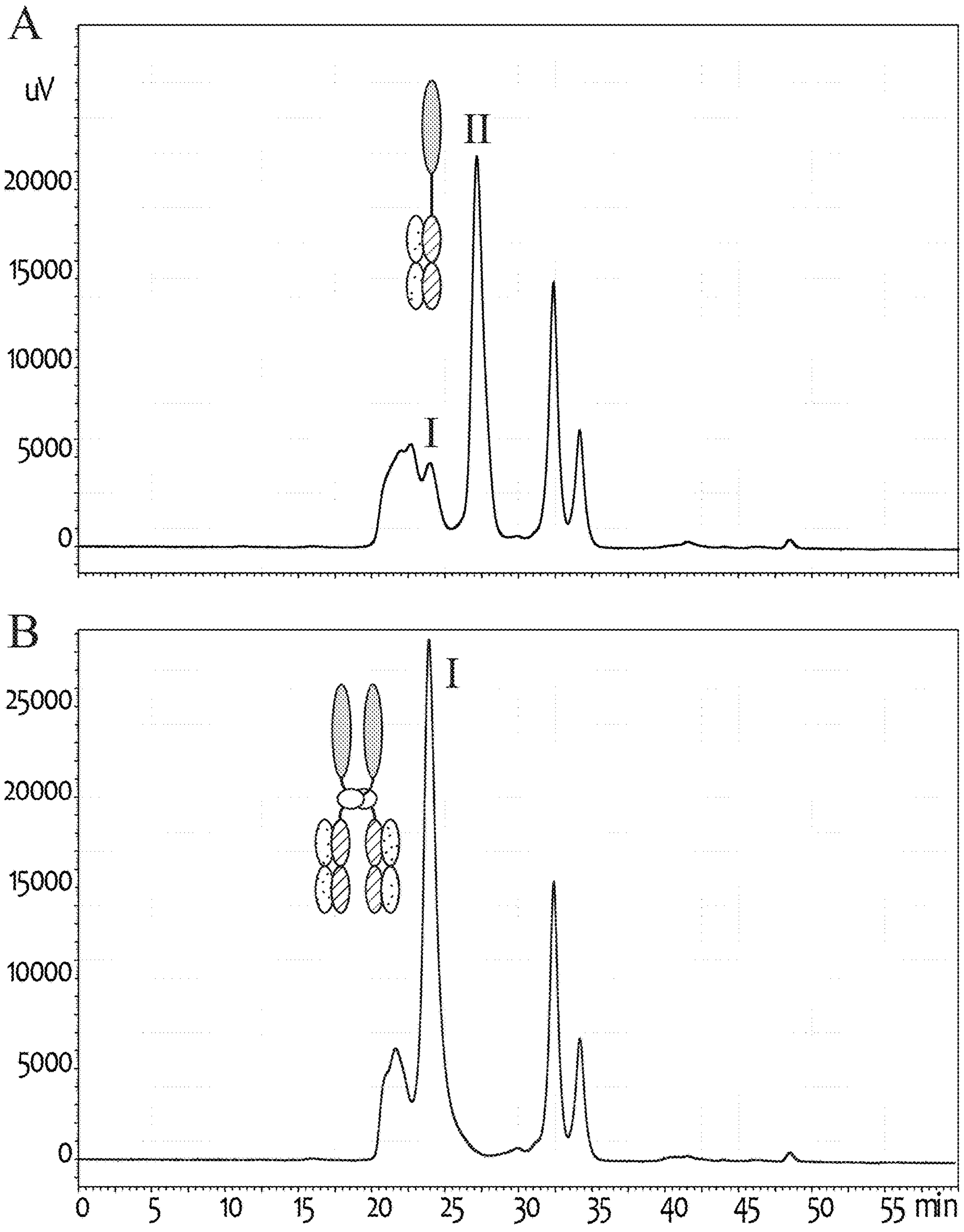
FIG. 15: Analysis of tetrahedral antibody ACE2RQ740c60PG-ACE2RQ740c60PG by SE-HPLC.

FIG. 15 shows analysis of tetrahedral antibody ACE2RQ740c60PG-ACE2RQ740c60PG by SE-HPLC.

Figure 16:
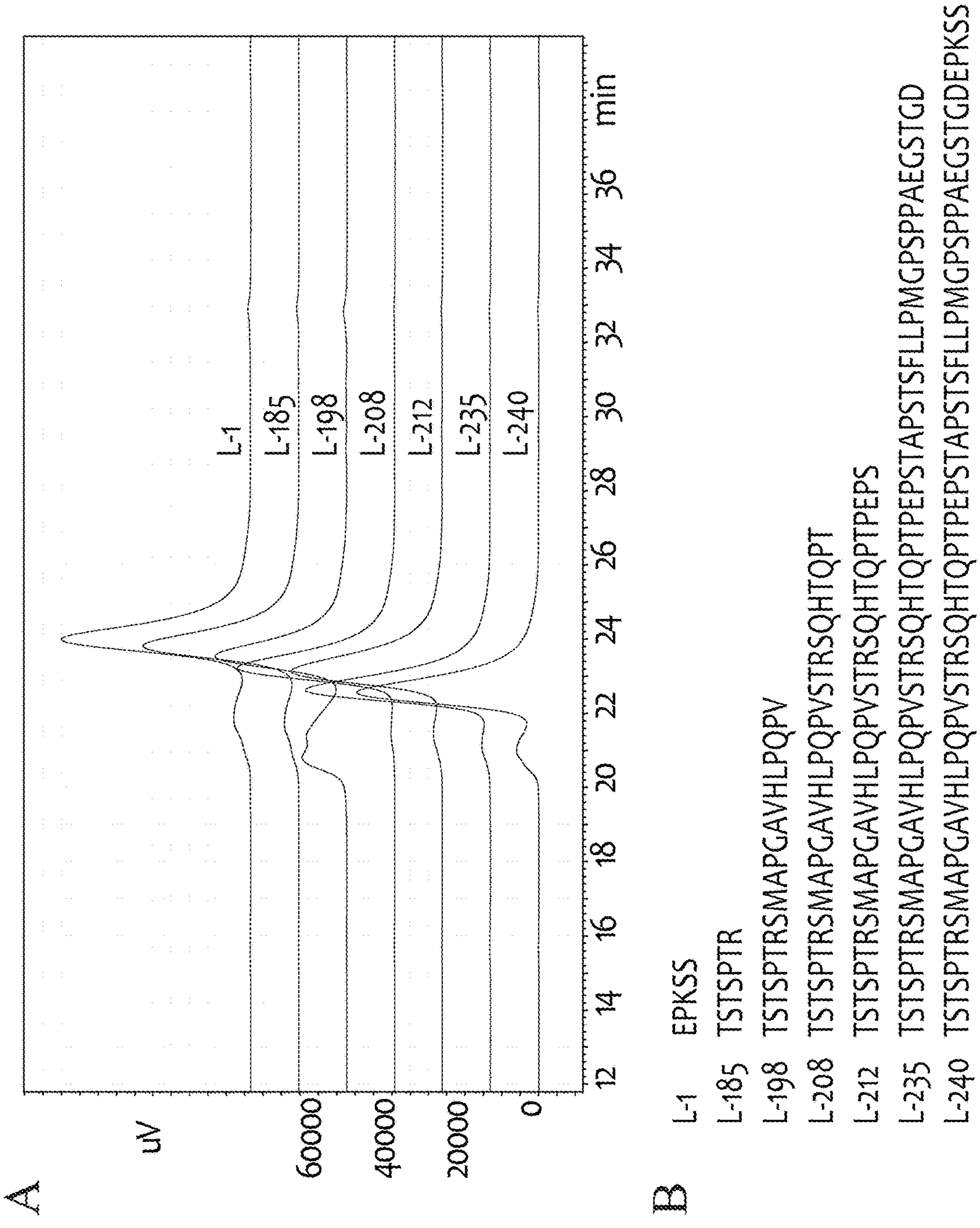
FIG. 16: Analysis of tetrahedral antibodies by SE-HPLC with different peptide linkers (L-1) ACE2RQ740c60PGRF-ACE2RQ740c60PGRF, (L-185) ACE2RQ740c60PGRF185-ACE2RQ740c60PGRF185, (L-198) ACE2RQ740c60PGRF198-ACE2RQ740c60PGRF198, (L-208) ACE2RQ740c60PGRF208-ACE2RQ740c60PGRF208, (L-212) ACE2RQ740c60PGRF235-ACE2RQ740c60PGRF235, (L-235) ACE2RQ740c60PGRF235-ACE2RQ740c60PGRF235, (L-240) ACE2RQ740c60PGRF240-ACE2RQ740c60PGRF240.

FIG. 16 shows analysis of tetrahedral antibodies by SE-HPLC with different peptide linkers (L-1) ACE2RQ740c60PGRF-ACE2RQ740c60PGRF, (L-185) ACE2RQ740c60PGRF185-ACE2RQ740c60PGRF185, (L-198) ACE2RQ740c60PGRF198-ACE2RQ740c60PGRF198, (L-208) ACE2RQ740c60PGRF208-ACE2RQ740c60PGRF208, (L-212) ACE2RQ740c60PGRF235-ACE2RQ740c60PGRF235, (L-235) ACE2RQ740c60PGRF235-ACE2RQ740c60PGRF235, (L-240) ACE2RQ740c60PGRF240-ACE2RQ740c60PGRF240.

Figure 17:
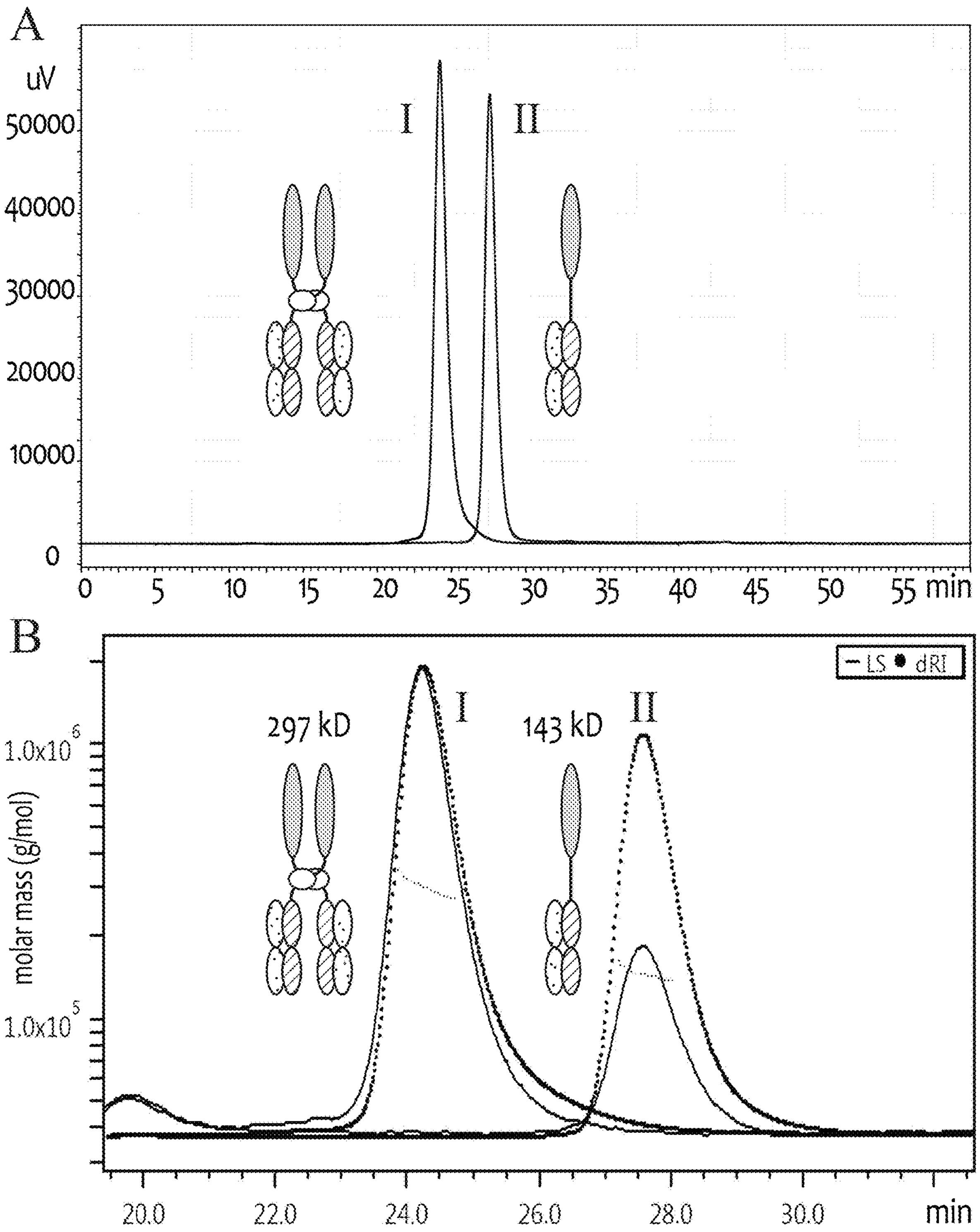
FIG. 17: Analysis of tetrahedral antibody ACE2RQ740c60PG-ACE2RQ740c60PG by SE-HPLC/MALS.

FIG. 17 shows analysis of tetrahedral antibody ACE2RQ740c60PG-ACE2RQ740c60PG by SE-HPLC/MALS.

Figure 18:
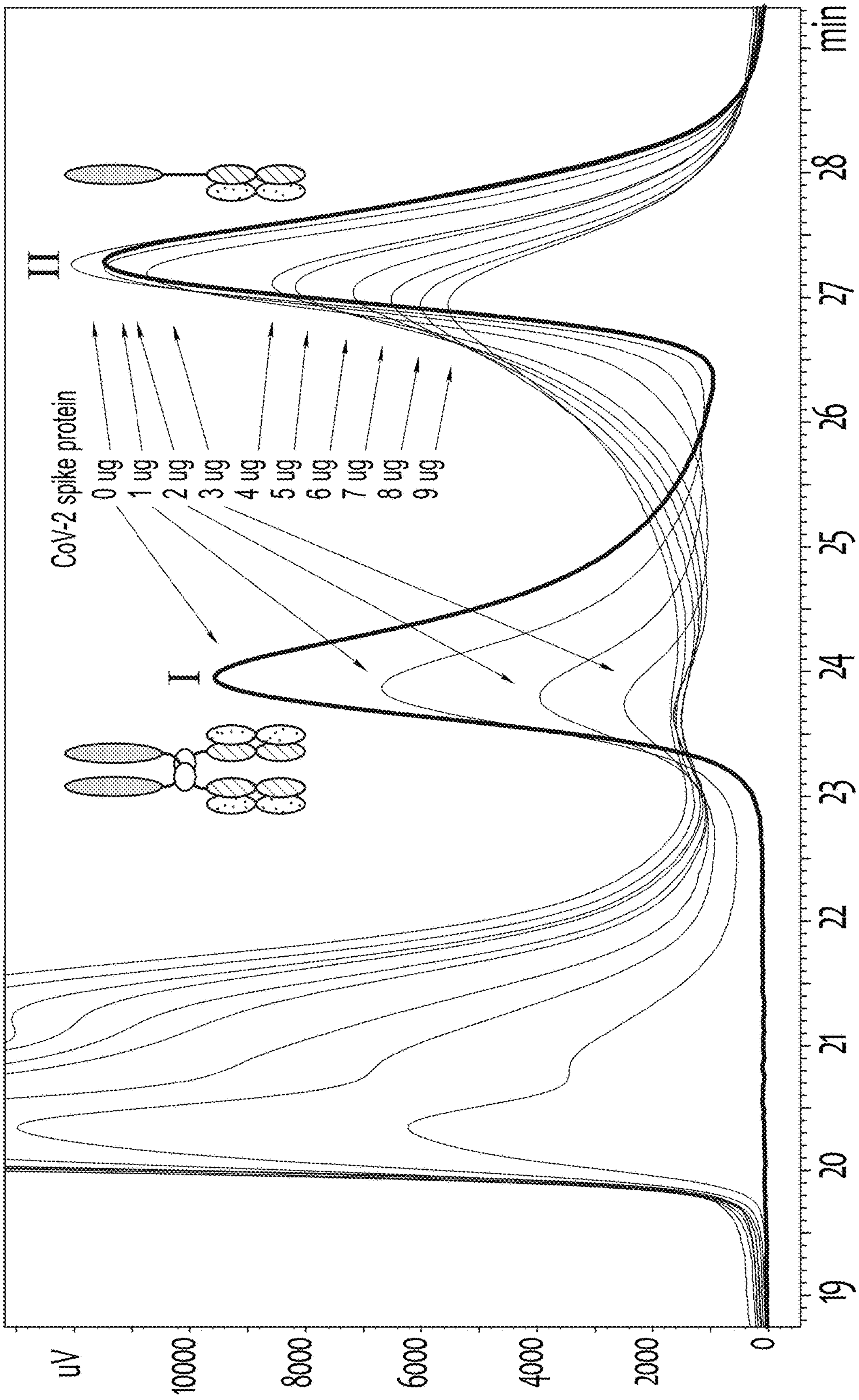
FIG. 18: Stoichiometric binding analysis of a mixture of tetrahedral antibody ACE2RQ740c60PG-ACE2RQ740c60PG and ACE monomer ACE2RQ615c60PG.

FIG. 18 describes the stoichiometric binding analysis of a mixture of tetrahedral antibody ACE2RQ740c60PG-ACE2RQ740c60PG and ACE monomer ACE2RQ615c60PG.

TABLE 10

SEQ IDs of Proteins Used for the Preparation of Tetrahedral Antibodies

| Protein name | Fc fusion chain | Linker length | Linker Sequence | Fc chain |
|---|---|---|---|---|
| ACE2RQ740c60PG | SEQ ID NO 65 | 5 | EPKSS (Residues 724-728 of SEQ ID NO 65) | SEQ ID NO 42 |
| ACE2RQ740c60PGRF-240 | SEQ ID NO 66 | 62 | TSTSPTRSMAPGAVHLP QPVSTRSQHTQPTPEPST APSTSFLLPMGPSPPAEG STGDEPKSS (Residues 724-785 of SEQ ID NO 66) | SEQ ID NO 73 |
| ACE2RQ740c60PGRF-235 | SEQ ID NO 67 | 57 | TSTSPTRSMAPGAVHLP QPVSTRSQHTQPTPEPST APSTSFLLPMGPSPPAEG STGD (Residues 724-780 of SEQ ID NO 67) | SEQ ID NO 73 |
| ACE2RQ740c60PGRF-212 | SEQ ID NO 68 | 34 | TSTSPTRSMAPGAVHLP QPVSTRSQHTQPTPEPS (Residues 724-757 of SEQ ID NO 68) | SEQ ID NO 73 |

TABLE 10-continued

SEQ IDs of Proteins Used for the Preparation of Tetrahedral Antibodies

| Protein name | Fc fusion chain | Linker length | Linker Sequence | Fc chain |
|---|---|---|---|---|
| ACE2RQ740c60PGRF-208 | SEQ ID NO 69 | 30 | TSTSPTRSMAPGAVHLP QPVSTRSQHTQPT (Residues 724-753 of SEQ ID NO 69) | SEQ ID NO 73 |
| ACE2RQ740c60PGRF-198 | SEQ ID NO 70 | 20 | TSTSPTRSMAPGAVHLP QPV (Residues 724-743 of SEQ ID NO 70) | SEQ ID NO 73 |
| ACE2RQ740c60PGRF-185 | SEQ ID NO 71 | 7 | TSTSPTR (Residues 724-730 of SEQ ID NO 71) | SEQ ID NO 73 |
| ACE2RQ740c60PGRF | SEQ ID NO 72 | 5 | EPKSS (Residues 724-728 of SEQ ID NO 72) | SEQ ID NO 73 |

TABLE 11

Tetrahedral Antibody formation by dimerization of the ACE2RQ740c60 protein

| Protein | ACE2 Tetrahedral Antibody retention time (minutes) | ACE2 Tetrahedral Antibody (%) | ACE2 Monomer retention time (minutes) | ACE2 Monomer (%) | HMW retention time (minutes) | HMW (%) |
|---|---|---|---|---|---|---|
| ACE2RQ615c60PG | ND | ND | 27.169 | 54.2 | 22.004-23.975 | 45.8 |
| ACE2RQ740c60PG | 23.912 | 76.1 | ND | ND | 21.642 | 23.9 |

ND; not detected;
HMW, high molecular weight

TABLE 12

Molar Mass of the SEC-purified ACE2RQ740c60 Tetrahedral Antibody by SE-HPLC/MALS

| ACE2 Tetrahedral Antibody | ACE2 Monomer | Tetrahedral Antibody retention time (minutes) | ACE2 Monomer retention time (minutes) | Molar Mass (kDa) |
|---|---|---|---|---|
| ACE2RQ740c60PG-ACE2RQ740c60PG | | 24.206 | ND | 297.4 (±1.9%) |
| | ACE2RQ615c60PG | ND | 27.567 | 143.4 (±1.7%) |

ND; not detected;
HMW, high molecular weight

TABLE 13

Tetrahedral Antibody Formation by Non-covalent Linkage of ACE2RQ740c60 Protein with Different Peptide Linkers

| Tetrahedral Antibody | Linker length | Linker sequence | Dimer retention time (minutes) | Dimer (%) | Monomer (%) | HMW (%) |
|---|---|---|---|---|---|---|
| ACE2RQ740c60PGRF240-ACE2RQ740c60PGRF240 | 62 | TSTSPTRSMAPGAVHLP QPVSTRSQHTQPTPEPS TAPSTSFLLPMGPSPPA EGSTGDEPKSS (Residues 724-785 of SEQ ID NO 66) | 22.566 | 87.7 | ND | 11.0 |

TABLE 13-continued

Tetrahedral Antibody Formation by Non-covalent Linkage of ACE2RQ740c60 Protein with Different Peptide Linkers

| Tetrahedral Antibody | Linker length | Linker sequence | Dimer retention time (minutes) | Dimer (%) | Monomer (%) | HMW (%) |
|---|---|---|---|---|---|---|
| ACE2RQ740c60PGRF235-ACE2RQ740c60PGRF235 | 57 | TSTSPTRSMAPGAVHLP QPVSTRSQHTQPTPEPS TAPSTSFLLPMGPSPPA EGSTGD (Residues 724-780 of SEQ ID NO 67) | 22.634 | 94.7 | ND | 4.0 |
| ACE2RQ740c60PGRF212-ACE2RQ740c60PGRF212 | 34 | TSTSPTRSMAPGAVHLP QPVSTRSQHTQPTPEPS (Residues 724-757 of SEQ ID NO 68) | 23.138 | 93.4 | ND | 5.4 |
| ACE2RQ740c60PGRF208-ACE2RQ740c60PGRF208 | 30 | TSTSPTRSMAPGAVHLP QPVSTRSQHTQPT (Residues 724-753 of SEQ ID NO 69) | 23.227 | 96.3 | ND | 2.4 |
| ACE2RQ740c60PGRF198-ACE2RQ740c60PGRF198 | 20 | TSTSPTRSMAPGAVHLP QPV (Residues 724-743 of SEQ ID NO 70) | 23.544 | 64.8 | ND | 32.8 |
| ACE2RQ740c60PGRF185-ACE2RQ740c60PGRF185 | 7 | TSTSPTR (Residues 724-730 of SEQ ID NO 71) | 23.817 | 87.6 | ND | 11.0 |
| ACE2RQ740c60PGRF-ACE2RQ740c60PGRF | 5 | EPKSS (Residues 724-728 of SEQ ID NO 72) | 23.995 | 88.0 | ND | 11.1 |

ND, not detected; HMW, high molecular weight

TABLE 14

Predicted Binding Domains of ACE2 Tetrahedral Antibodies

| Tetrahedral Antibody | D1 binding specificity | D2 binding specificity | D3 binding specificity | D4 binding specificity |
|---|---|---|---|---|
| ACE2RQ740c60PG-ACE2RQ740c60PG | FcRn, FcRγ-low | FcRn, FcRγ-low | SARS-CoV-2 Spike protein | SARS-CoV-2 Spike protein |
| ACE2RQ740c60PGRF240-ACE2RQ740c60PGRF240 | FeRn, FcRγ-low | FcRn, FcRγ-low | SARS-CoV-2 Spike protein | SARS-CoV-2 Spike protein |
| ACE2RQ740c60PGRF235-ACE2RQ740c60PGRF235 | FcRn, FcRγ-low | FcRn, FcRγ-low | SARS-CoV-2 Spike protein | SARS-CoV-2 Spike protein |
| ACE2RQ740c60PGRF212-ACE2RQ740c60PGRF212 | FcRn, FcRγ-low | FcRn, FcRγ-low | SARS-CoV-2 Spike protein | SARS-CoV-2 Spike protein |
| ACE2RQ740c60PGRF208-ACE2RQ740c60PGRF208 | FcRn, FcRγ-low | FcRn, FcRγ-low | SARS-CoV-2 Spike protein | SARS-CoV-2 Spike protein |
| ACE2RQ740c60PGRF198-ACE2RQ740c60PGRF198 | FcRn, FcRγ-low | FcRn, FcRγ-low | SARS-CoV-2 Spike protein | SARS-CoV-2 Spike protein |
| ACE2RQ740c60PGRF185-ACE2RQ740c60PGRF185 | FcRn, FcRγ-low | FcRn, FcRγ-low | SARS-CoV-2 Spike protein | SARS-CoV-2 Spike protein |
| ACE2RQ740c60PGRF-ACE2RQ740c60PGRF | FcRn, FcRγ-low | FcRn, FcRγ-low | SARS-CoV-2 Spike protein | SARS-CoV-2 Spike protein |

Example 5—Tetrahedral Antibodies with the Structure Shown in Panel D of FIG. 1 and FIGS. 5-10, 19-28

Panel D of FIG. 1 and FIGS. 5-10 show the schematic structure of tetrahedral antibodies of this example.

Figure 19:
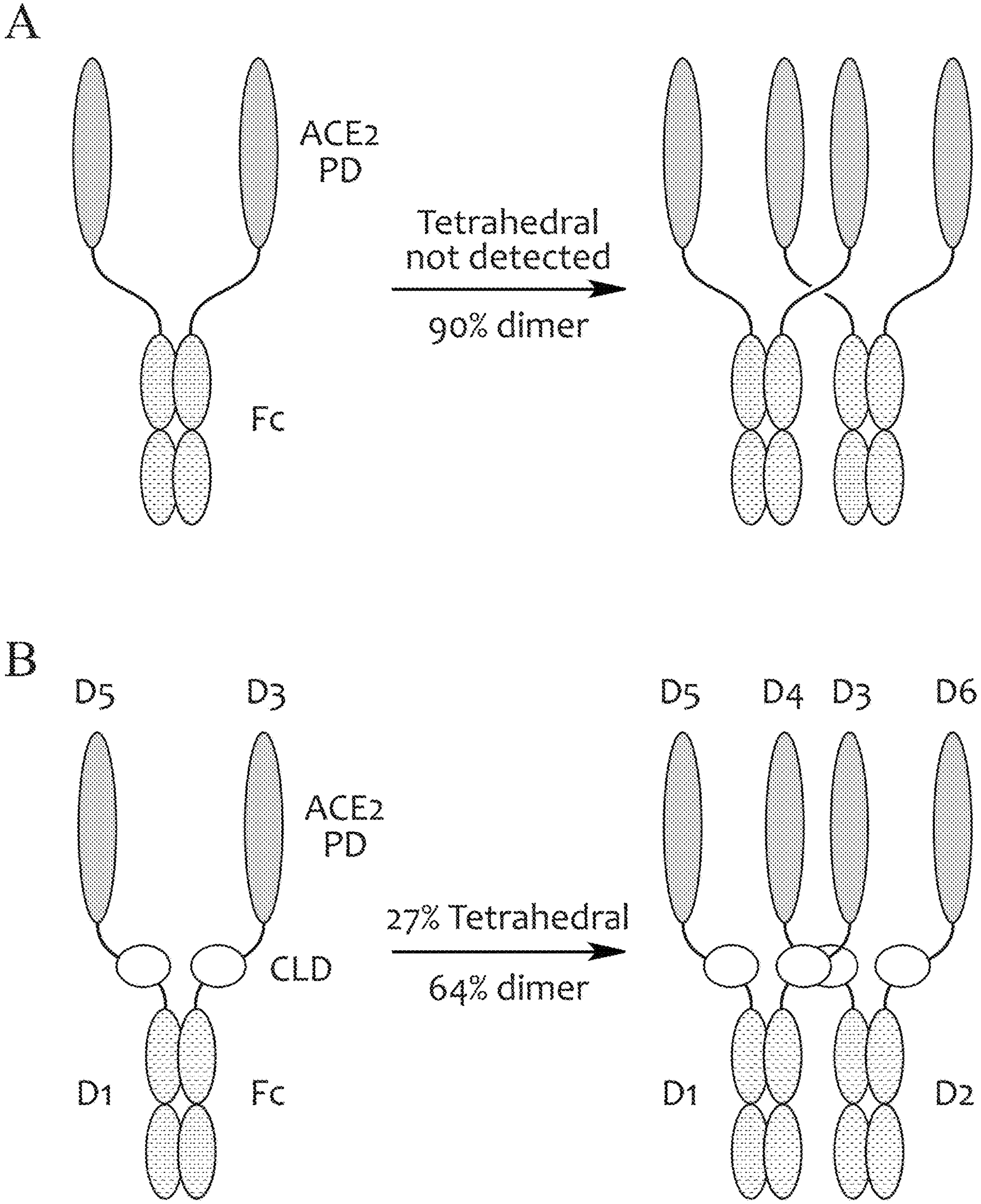
FIG. 19: Preparation of tetrahedral antibody ACE2740FcG9-ACE2740FcG9.

FIG. 19 describes preparation of tetrahedral antibody ACE2740FcG9-ACE2740FcG9.

Figure 20:
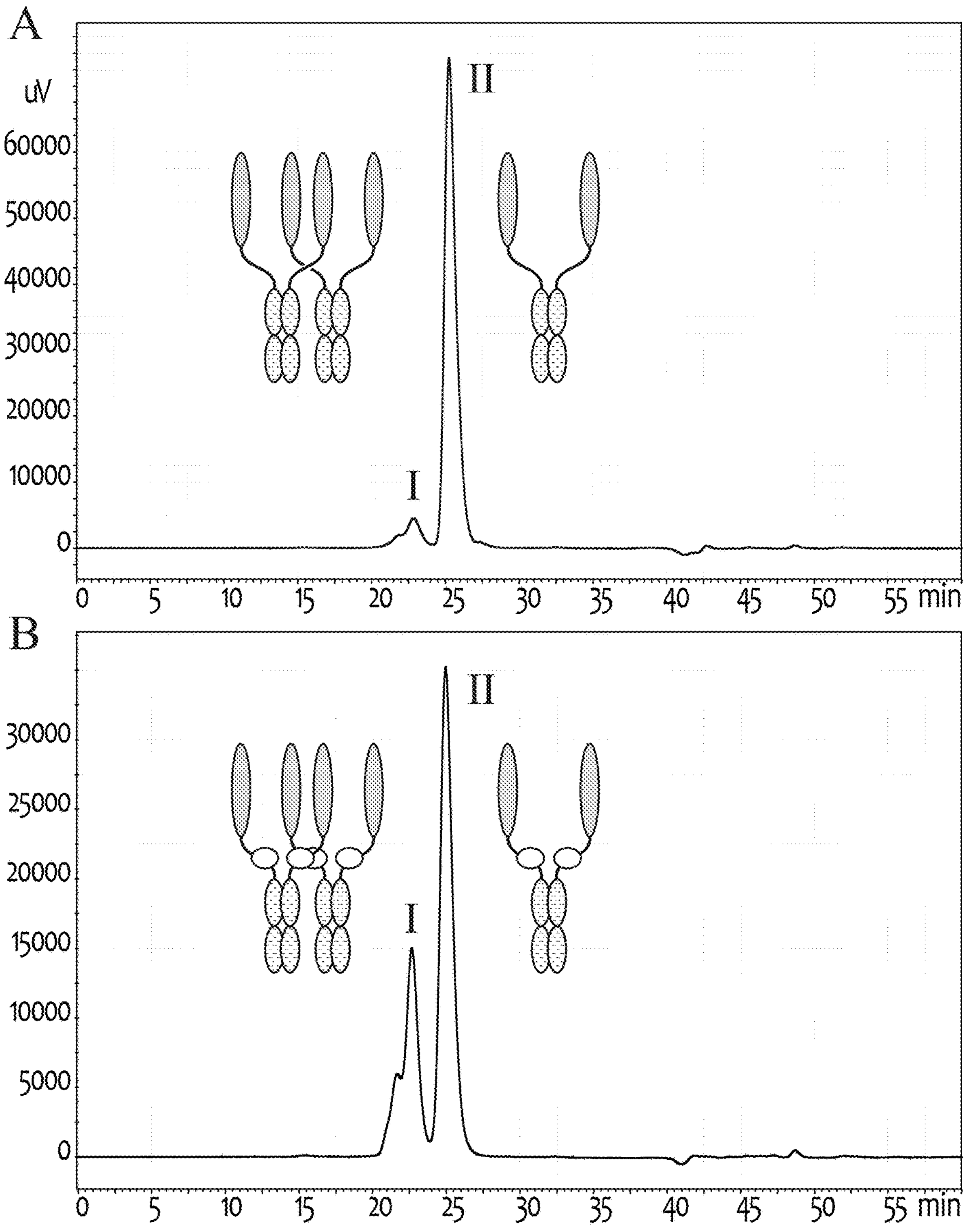
FIG. 20: Analysis of tetrahedral antibody ACE2740FcG9-ACE2740FcG9 by SE-HPLC.

FIG. 20 shows analysis of tetrahedral antibody ACE2740FcG9-ACE2740FcG9 by SE-HPLC.

Figure 21:
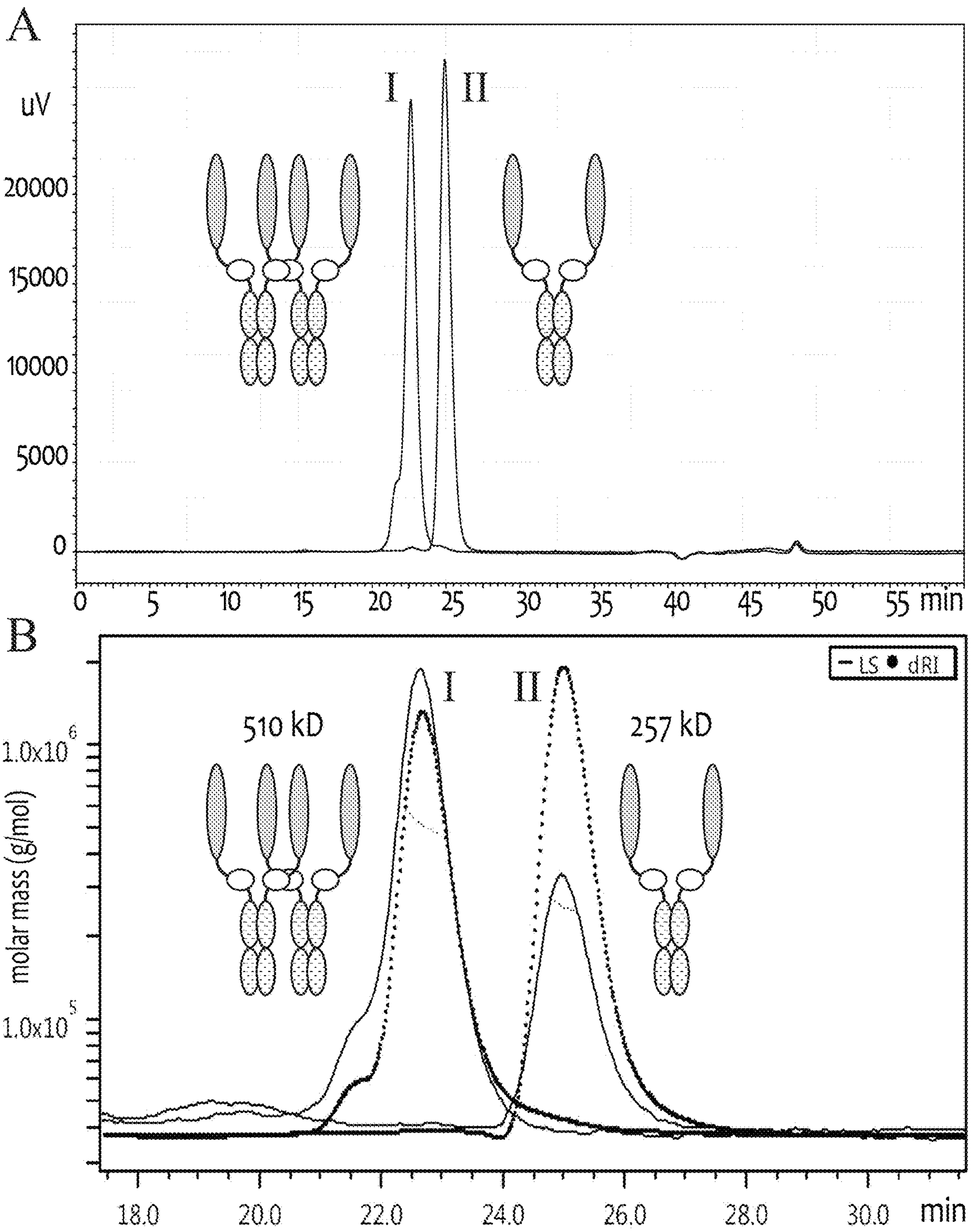
FIG. 21: Analysis of tetrahedral antibody ACE2740FcG9-ACE2740FcG9 by SE-HPLC/MALS.

FIG. 21 shows analysis of tetrahedral antibody ACE2740FcG9-ACE2740FcG9 by SE-HPLC/MALS.

Figure 22:
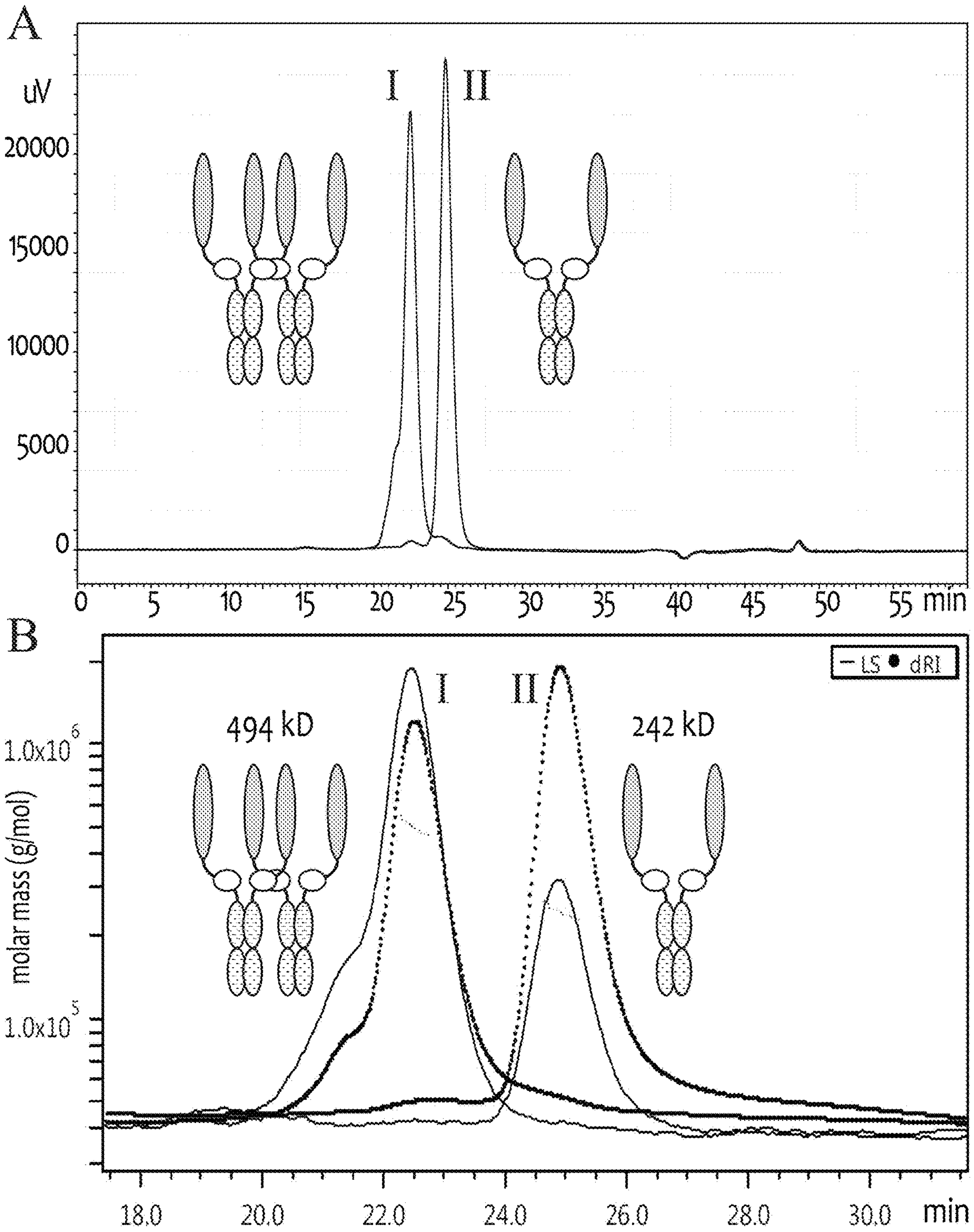
FIG. 22: Analysis of tetrahedral antibody ACE2RQ740FcPG-ACE2RQ740FcPG by SE-HPLC/MALS.

FIG. 22 shows analysis of tetrahedral antibody ACE2RQ740FcPG-ACE2RQ740FcPG by SE-HPLC/MALS.

Figure 23:
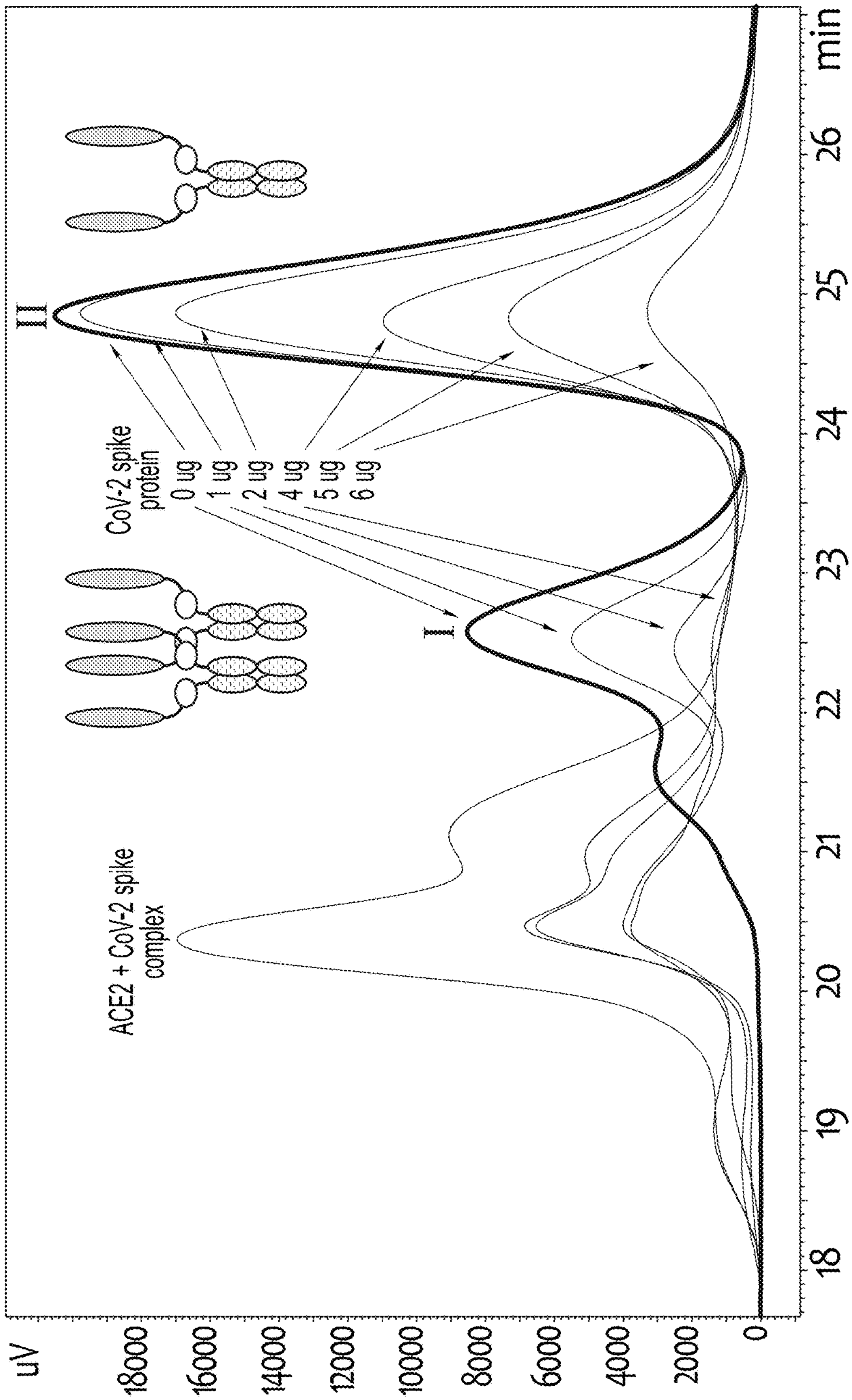
FIG. 23: Stoichiometric binding analysis of an impure preparation of tetrahedral antibody ACE2740FcG9-ACE2740FcG9 and ACE2 dimer ACE2740FcG9.

FIG. 23 shows stoichiometric binding analysis of an impure preparation of tetrahedral antibody ACE2740FcG9-ACE2740FcG9 and ACE2 dimer ACE2740FcG9.

Figure 24:
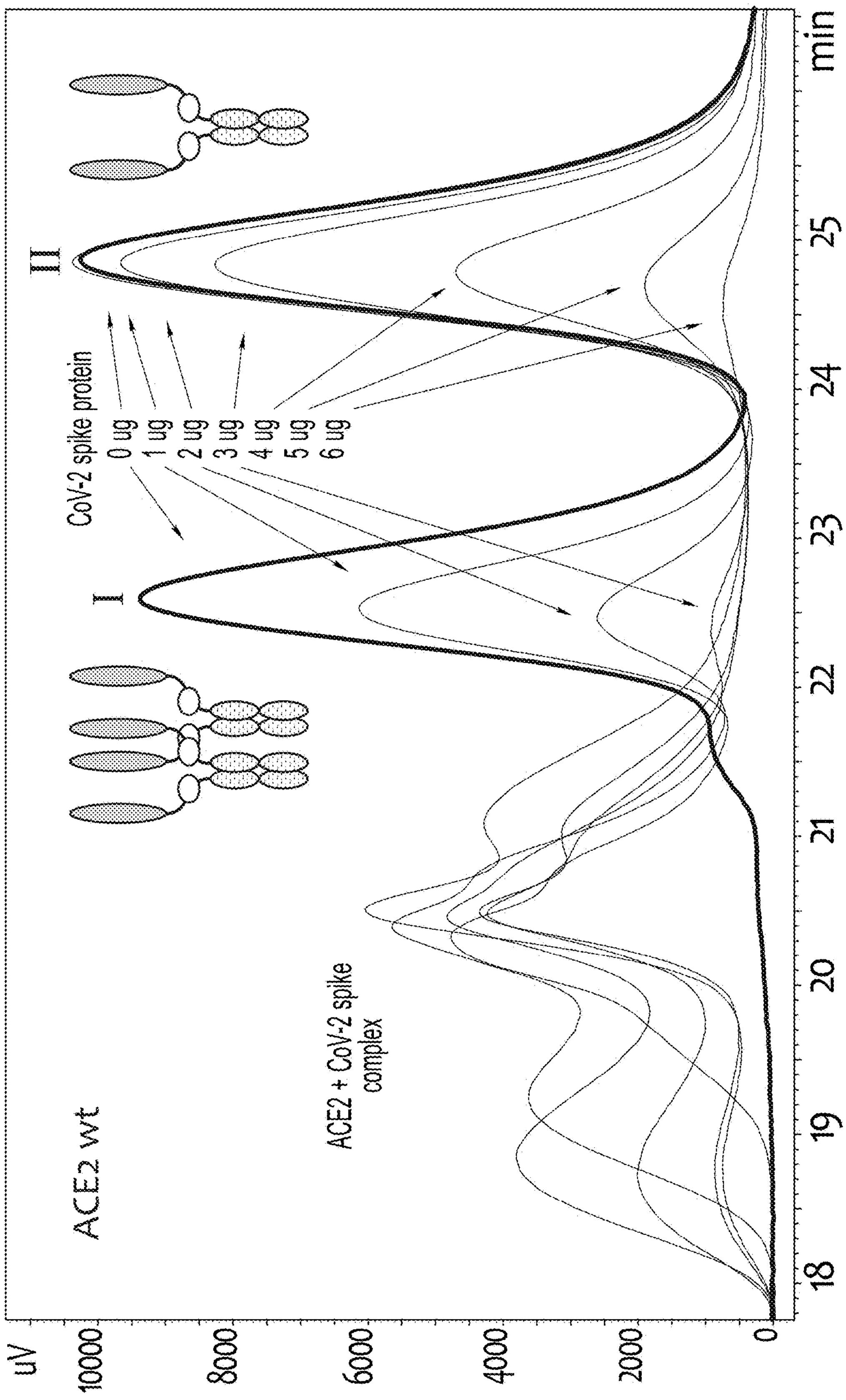
FIG. 24: Stoichiometric binding analysis of a mixture of tetrahedral antibody ACE2740FcG9-ACE2740FcG9 and ACE2 dimer ACE2-740Fc-G9.

FIG. 24 shows stoichiometric binding analysis of a mixture of tetrahedral antibody ACE2740FcG9-ACE2740FcG9 and ACE2 dimer ACE2-740Fc-G9.

Figure 25:
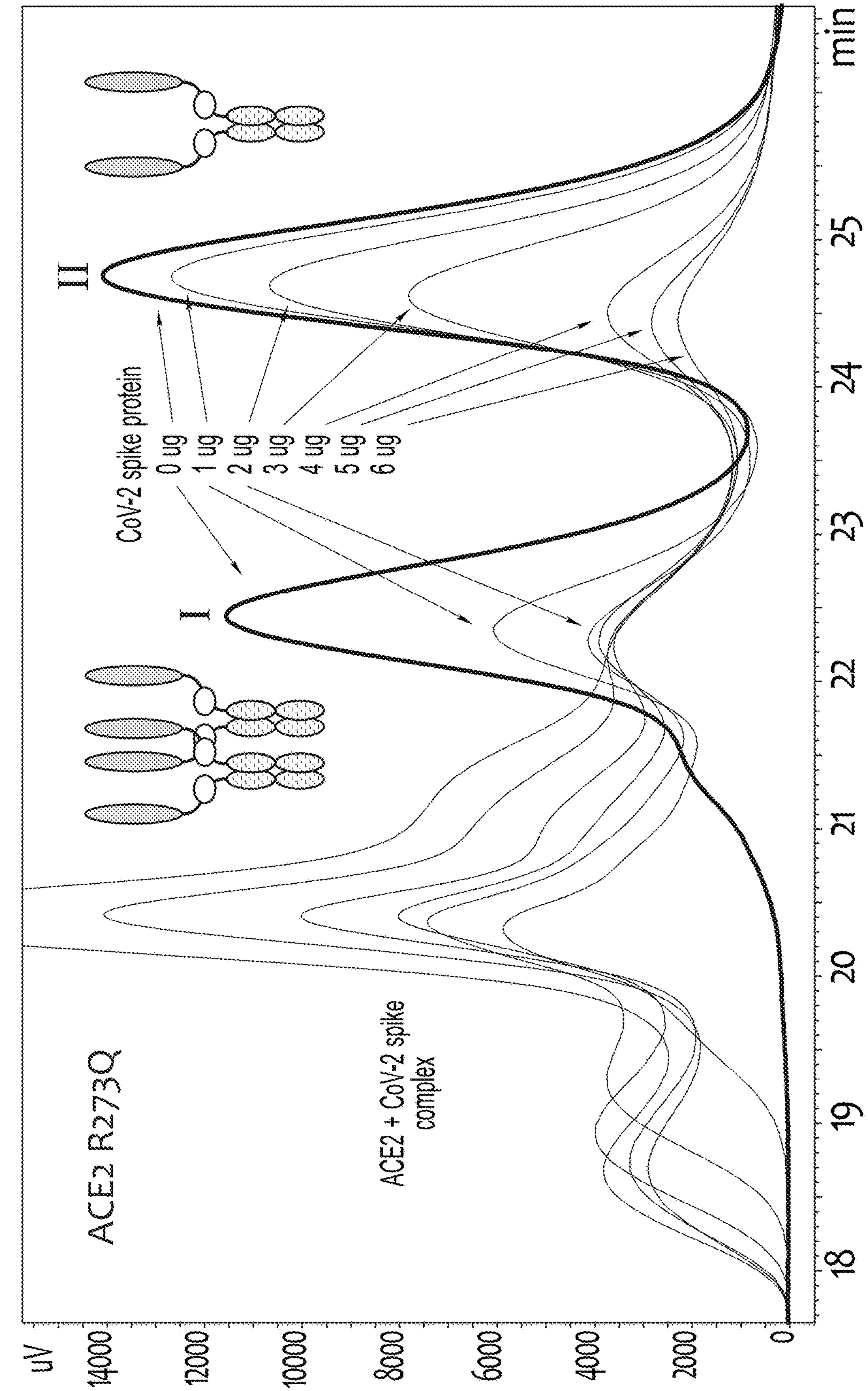
FIG. 25: Stoichiometric binding analysis of a mixture of tetrahedral antibody ACE2RQ740FcPG-ACE2RQ740FcPG and ACE2 dimer ACE2-740Fc-G9.

FIG. 25 shows stoichiometric binding analysis of a mixture of tetrahedral antibody ACE2RQ740FcPG-ACE2RQ740FcPG and ACE2 dimer ACE2-740Fc-G9.

Figure 26:
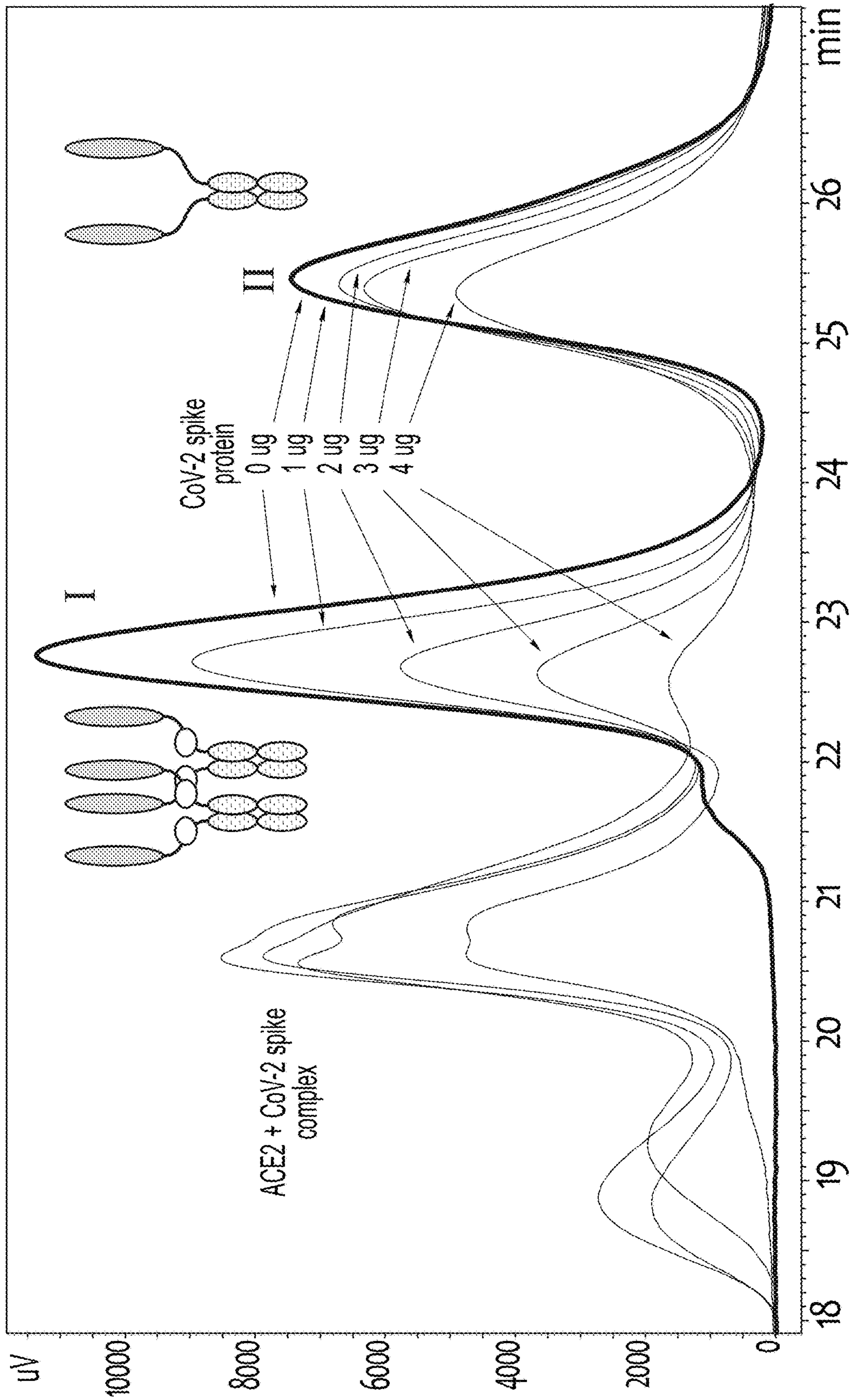
FIG. 26: Stoichiometric binding analysis of a mixture of tetrahedral antibody ACE2740FcG9-ACE2740FcG9 and ACE2 dimer ACE2-615Fc-G9.

FIG. 26 shows stoichiometric binding analysis of a mixture of tetrahedral antibody ACE2740FcG9-ACE2740FcG9 and ACE2 dimer ACE2-615Fc-G9.

Figure 27:
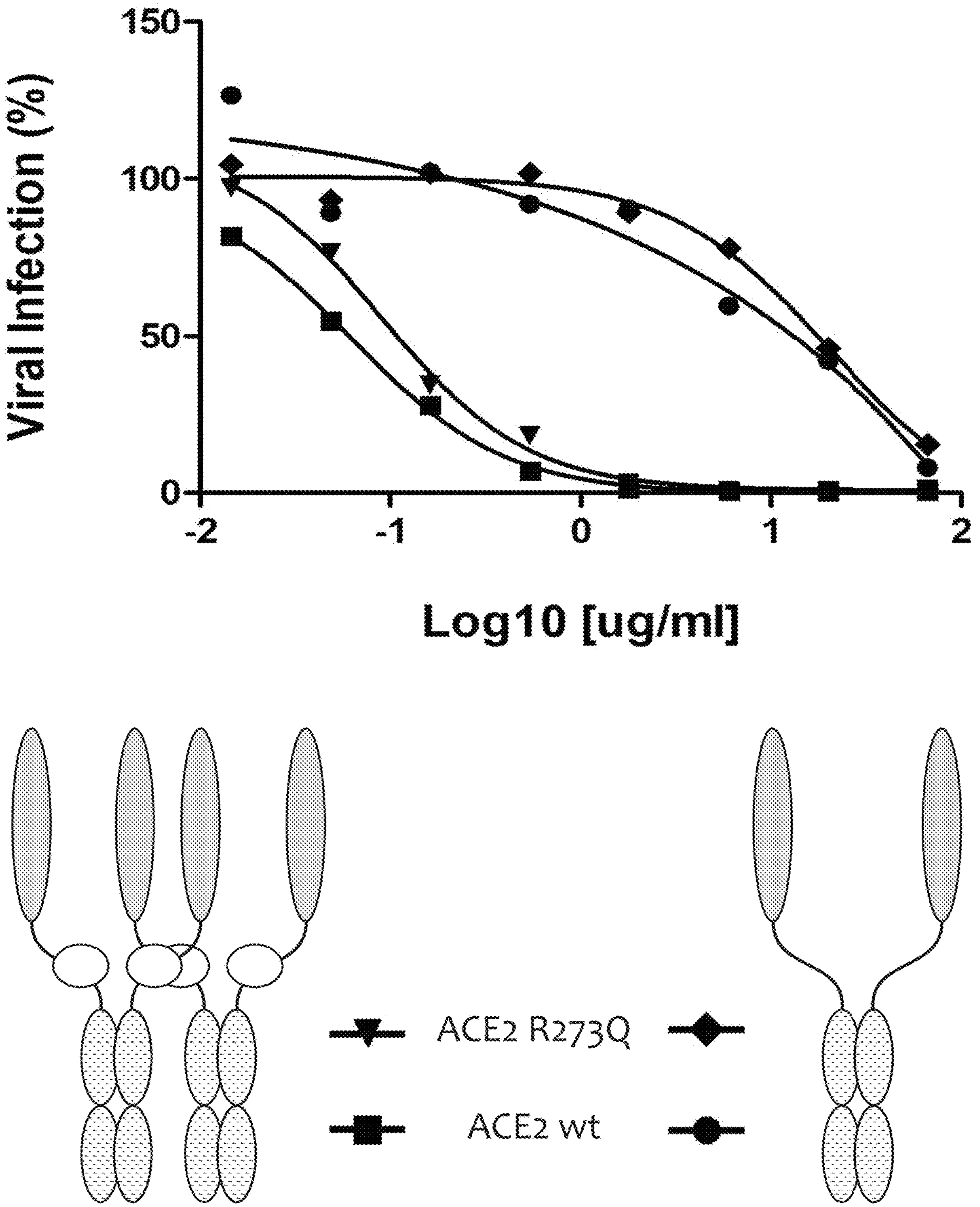
FIG. 27: Inhibition of SARS-CoV-2-VSV pseudotype virus infection by ACE2 tetrahedral antibodies ACE2740FcG9-ACE2740FcG9 and ACE2RQ740FcPG-ACE2RQ740FcPG, and by ACE2 dimers ACE2-615Fc-G9 and ACE2RQ615FcPG.

FIG. 27 shows inhibition of SARS-CoV-2-VSV pseudotype virus infection by ACE2 tetrahedral antibodies ACE2740FcG9-ACE2740FcG9 and ACE2RQ740FcPG-ACE2RQ740FcPG, and by ACE2 dimers ACE2-615Fc-G9 and ACE2RQ615FcPG.

Figure 28:
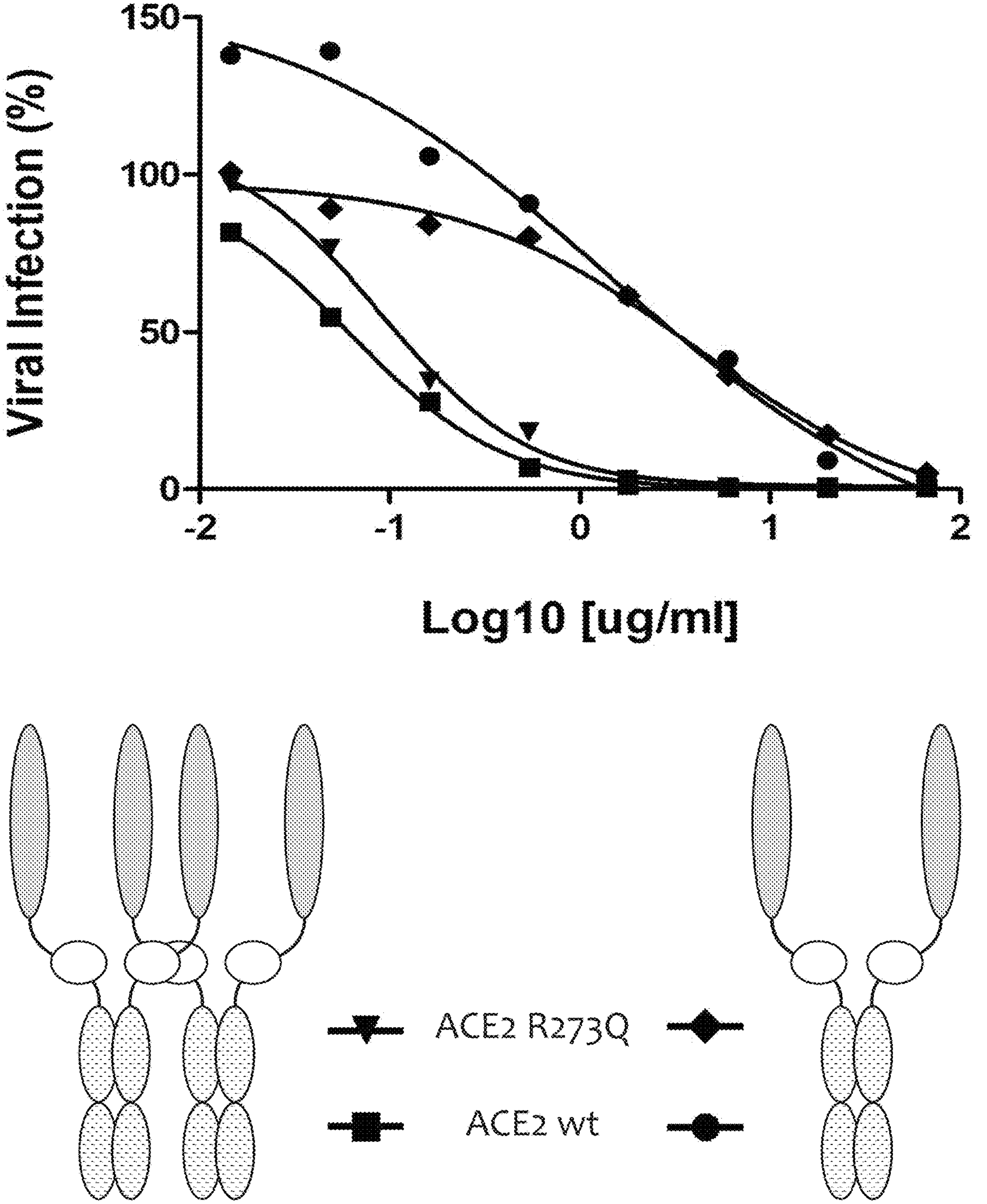
FIG. 28: Inhibition of SARS-CoV-2-VSV pseudotype virus infection by ACE2 tetrahedral antibodies ACE2740FcG9-ACE2740FcG9 and ACE2RQ740FcPG-ACE2RQ740FcPG, and by ACE2 dimers ACE2-740Fc-G9 and ACE2RQ740FcPG.

FIG. 28 shows inhibition of SARS-CoV-2-VSV pseudotype virus infection by ACE2 tetrahedral antibodies ACE2740FcG9-ACE2740FcG9 and ACE2RQ740FcPG-ACE2RQ740FcPG, and by ACE2 dimers ACE2-740Fc-G9 and ACE2RQ740FcPG.

TABLE 15

SEQ IDs of Proteins Used for the Preparation of Tetrahedral Antibodies

| Protein name | Fc fusion chain | Linker length | Linker Sequence |
|---|---|---|---|
| ACE2-615Fc-G9 | SEQ ID NO 74 | 9 | GGGGAGGGG (Residues 598-607 of SEQ ID NO: 74) |
| ACE2-740Fc-G9 | SEQ ID NO 75 | 9 | GGGGAGGGG (Residues 724-732 of SEQ ID NO: 75) |
| ACE2RQ615FcPG | SEQ ID NO 76 | 5 | EPKSS (Residues 598-603 of SEQ ID NO: 76) |
| ACE2RQ740FcPG | SEQ ID NO 77 | 5 | EPKSS (Residues 724-728 of SEQ ID NO: 77) |
| ACE2RQ740FcPG-G9 | SEQ ID NO 78 | 9 | GGGGAGGGG (Residues 724-732 of SEQ ID NO: 78) |
| ACE2-740FcPG-G9 | SEQ ID NO 79 | 9 | GGGGAGGGG (Residues 724-732 of SEQ ID NO: 79) |
| ACE2RQ740Fc-G9 | SEQ ID NO 80 | 9 | GGGGAGGGG (Residues 724-732 of SEQ ID NO: 80) |
| ACE2-740Fc-G9 | SEQ ID NO 81 | 9 | GGGGAGGGG (Residues 724-732 of SEQ ID NO: 81) |
| ACE2RQ740FcPG-235 | SEQ ID NO 90 | 57 | TSTSPTRSMAPGAVHLPQPVSTRSQHTQPTPEPS TAPSTSFLLPMGPSPPAEGSTGD (Residues 724-780 of SEQ ID NO: 90) |
| ACE2RQ740FcPG-212 | SEQ ID NO 91 | 34 | TSTSPTRSMAPGAVHLPQPVSTRSQHTQPTPEPS (Residues 724-757 of SEQ ID NO: 91) |
| ACE2RQ740FcPG-208 | SEQ ID NO 92 | 30 | TSTSPTRSMAPGAVHLPQPVSTRSQHTQPT (Residues 724-753 of SEQ ID NO: 92) |
| ACE2RQ740FcPG-202 | SEQ ID NO 93 | 24 | TSTSPTRSMAPGAVHLPQPVSTRS (Residues 724-747 of SEQ ID NO: 93) |
| ACE2RQ740FcPG-201 | SEQ ID NO 94 | 23 | TSTSPTRSMAPGAVHLPQPVSTR (Residues 724-746 of SEQ ID NO: 94) |
| ACE2RQ740FcPG-200 | SEQ ID NO 95 | 22 | TSTSPTRSMAPGAVHLPQPVST (Residues 724-745 of SEQ ID NO: 95) |
| ACE2RQ740FcPG-199 | SEQ ID NO 96 | 21 | TSTSPTRSMAPGAVHLPQPVS (Residues 724-744 of SEQ ID NO: 96) |
| ACE2RQ740FcPG-198 | SEQ ID NO 97 | 20 | TSTSPTRSMAPGAVHLPQPV (Residues 724-743 of SEQ ID NO: 97) |
| ACE2RQ740FcPG-197 | SEQ ID NO 98 | 19 | TSTSPTRSMAPGAVHLPQP (Residues 724-742 of SEQ ID NO: 98) |
| ACE2RQ740FcPG-196 | SEQ ID NO 99 | 18 | TSTSPTRSMAPGAVHLPQ (Residues 724-741 of SEQ ID NO: 99) |
| ACE2RQ740FcPG-195 | SEQ ID NO 100 | 17 | TSTSPTRSMAPGAVHLP (Residues 724-740 of SEQ ID NO: 100) |
| ACE2RQ740FcPG-194 | SEQ ID NO 101 | 16 | TSTSPTRSMAPGAVHL (Residues 724-739 of SEQ ID NO: 101) |
| ACE2RQ740FcPG-193 | SEQ ID NO 102 | 15 | TSTSPTRSMAPGAVH (Residues 724-738 of SEQ ID NO: 102) |
| ACE2RQ740FcPG-192 | SEQ ID NO 103 | 14 | TSTSPTRSMAPGAV (Residues 724-737 of SEQ ID NO: 103) |

TABLE 15-continued

SEQ IDs of Proteins Used for the Preparation of Tetrahedral Antibodies

| Protein name | Fc fusion chain | Linker length | Linker Sequence |
|---|---|---|---|
| ACE2RQ740FcPG-191 | SEQ ID NO 104 | 13 | TSTSPTRSMAPGA (Residues 724-736 of SEQ ID NO: 104) |
| ACE2RQ740FcPG-190 | SEQ ID NO 105 | 12 | TSTSPTRSMAPG (Residues 724-735 of SEQ ID NO: 105) |
| ACE2RQ740FcPG-189 | SEQ ID NO 106 | 11 | TSTSPTRSMAP (Residues 724-734 of SEQ ID NO: 106) |
| ACE2RQ740FcPG-188 | SEQ ID NO 107 | 10 | TSTSPTRSMA (Residues 724-733 of SEQ ID NO: 107) |
| ACE2RQ740FcPG-187 | SEQ ID NO 108 | 9 | TSTSPTRSM (Residues 724-732 of SEQ ID NO: 108) |
| ACE2RQ740FcPG-186 | SEQ ID NO 109 | 8 | TSTSPTRS (Residues 724-731 of SEQ ID NO: 109) |
| ACE2RQ740FcPG-185 | SEQ ID NO 110 | 7 | TSTSPTR (Residues 724-730 of SEQ ID NO: 110) |
| ACE2RQ740FcPG-184 | SEQ ID NO 111 | 6 | TSTSPT (Residues 724-729 of SEQ ID NO: 111) |
| ACE2RQ740FcPG-183 | SEQ ID NO 112 | 5 | TSTSP (Residues 724-728 of SEQ ID NO: 105) |
| ACE2RQ740FcPG-G14 | SEQ ID NO 113 | 14 | GGGGAGGGGAGGGG (Residues 724-737 of SEQ ID NO: 113) |
| ACE2RQ740FcPG-G12 | SEQ ID NO 114 | 12 | GGAGGGGAGGGG (Residues 724-735 of SEQ ID NO: 114) |
| ACE2RQ740FcPG-G10 | SEQ ID NO 115 | 10 | AGGGGAGGGG (Residues 724-733 of SEQ ID NO: 115) |
| ACE2RQ740FcPG-G8 | SEQ ID NO 116 | 8 | GGGAGGGG (Residues 724-731 of SEQ ID NO: 116) |
| ACE2RQ740FcPG-G7 | SEQ ID NO 117 | 7 | GGAGGGG (Residues 724-730 of SEQ ID NO: 117) |
| ACE2RQ740FcPG-G6 | SEQ ID NO 118 | 6 | GAGGGG (Residues 724-729 of SEQ ID NO: 118) |
| ACE2RQ740FcPG-G5 | SEQ ID NO 119 | 5 | AGGGG (Residues 724-728 of SEQ ID NO: 119) |

TABLE 16

Tetrahedral Antibody formation by dimerization of the ACE2RQ740c60 and ACE2-740Fc-G9 proteins

| Protein name | ACE2 Tetrahedral Antibody retention time (minutes) | ACE2 Tetrahedral Antibody (%) | ACE2 Dimer retention time (minutes) | ACE2 Dimer (%) | High Mol Wt retention time (minutes) | High Molecular Weight (%) |
|---|---|---|---|---|---|---|
| ACE2-615Fc-G9 | ND | ND | 25.255 | 90.1 | 21.956-22.857 | 8.6 |
| ACE2-740Fc-G9 | 22.674 | 26.7 | 24.960 | 63.8 | 21.679 | 8.9 |

TABLE 17

| Molar Mass of SEC-purified ACE2 Tetrahedral Antibodies by SE–HLPC/MALS | | | |
|---|---|---|---|
| ACE2 Tetrahedral Antibody | ACE2 DIMER | Retention time (minutes) | Molar Mass (kDa) |
| ACE2740FcG9-ACE2740FcG9 | | 22.621 | 510.1 (±2.3%) |
| | ACE2-740Fc-G9 | 24.919 | 256.6 (±2.9%) |

TABLE 17-continued

| Molar Mass of SEC-purified ACE2 Tetrahedral Antibodies by SE–HLPC/MALS | | | |
|---|---|---|---|
| ACE2 Tetrahedral Antibody | ACE2 DIMER | Retention time (minutes) | Molar Mass (kDa) |
| ACE2RQ740FcPG-ACE2RQ740FcPG | | 22.454 | 493.8 (±2.0%) |
| | ACE2RQ740FcPG | 24.831 | 242.4 (±3.6%) |

TABLE 18

| Binding domains of Tetrahedral Antibodies | | | |
|---|---|---|---|
| Tetrahedral Antibody | D1/D2 binding specificity | D3/D4 binding specificity | D5/D6 binding specificity |
| ACE2615FcG9-ACE2615FcG9 | NA | NA | NA |
| ACE2740FcG9-ACE2740FcG9 | FcRn, FcRγ-low | FcRn, FcRγ-low | SARS-CoV-2 Spike protein |
| ACE2RQ615FcPG-ACE2RQ615FcPG | NA | NA | NA |
| ACE2RQ740FcPG-ACE2RQ740FcPG | FcRn, FcRγ-low | SARS-CoV-2 Spike protein | SARS-CoV-2 Spike protein |
| ACE2RQ740FcPGG9-ACE2RQ740FcPGG9 | FcRn, FcRγ-low | SARS-CoV-2 Spike protein | SARS-CoV-2 Spike protein |
| ACE2740FcPGG9-ACE2740FcPGG9 | FcRn, FcRγ-low | SARS-CoV-2 Spike protein | SARS-CoV-2 Spike protein |
| ACE2RQ740FcG9-ACE2RQ740FcG9 | FcRn, FcRγ-low | SARS-CoV-2 Spike protein | SARS-CoV-2 Spike protein |
| ACE2740FcG9-ACE2740FcG9 | FcRn, FcRγ-low | SARS-CoV-2 Spike protein | SARS-CoV-2 Spike protein |
| ACE2RQ740FcPG235-ACE2RQ740FcPG235 | FcRn, FcRγ-low | SARS-CoV-2 Spike protein | SARS-CoV-2 Spike protein |
| ACE2RQ740FcPG212-ACE2RQ740FcPG212 | FcRn, FcRγ-low | SARS-CoV-2 Spike protein | SARS-CoV-2 Spike protein |
| ACE2RQ740FcPG208-ACE2RQ740FcPG208 | FcRn, FcRγ-low | SARS-CoV-2 Spike protein | SARS-CoV-2 Spike protein |
| ACE2RQ740FcPG202-ACE2RQ740FcPG202 | FcRn, FcRγ-low | SARS-CoV-2 Spike protein | SARS-CoV-2 Spike protein |
| ACE2RQ740FcPG201-ACE2RQ740FcPG201 | FcRn, FcRγ-low | SARS-CoV-2 Spike protein | SARS-CoV-2 Spike protein |
| ACE2RQ740FcPG200-ACE2RQ740FcPG200 | FcRn, FcRγ-low | SARS-CoV-2 Spike protein | SARS-CoV-2 Spike protein |
| ACE2RQ740FcPG199-ACE2RQ740FcPG199 | FcRn, FcRγ-low | SARS-CoV-2 Spike protein | SARS-CoV-2 Spike protein |
| ACE2RQ740FcPG198-ACE2RQ740FcPG198 | FcRn, FcRγ-low | SARS-CoV-2 Spike protein | SARS-CoV-2 Spike protein |
| ACE2RQ740FcPG197-ACE2RQ740FcPG197 | FcRn, FcRγ-low | SARS-CoV-2 Spike protein | SARS-CoV-2 Spike protein |
| ACE2RQ740FcPG196-ACE2RQ740FcPG196 | FcRn, FcRγ-low | SARS-CoV-2 Spike protein | SARS-CoV-2 Spike protein |
| ACE2RQ740FcPG195-ACE2RQ740FcPG195 | FcRn, FcRγ-low | SARS-CoV-2 Spike protein | SARS-CoV-2 Spike protein |
| ACE2RQ740FcPG194-ACE2RQ740FcPG194 | FcRn, FcRγ-low | SARS-CoV-2 Spike protein | SARS-CoV-2 Spike protein |
| ACE2RQ740FcPG193-ACE2RQ740FcPG193 | FcRn, FcRγ-low | SARS-CoV-2 Spike protein | SARS-CoV-2 Spike protein |
| ACE2RQ740FcPG192-ACE2RQ740FcPG192 | FcRn, FcRγ-low | SARS-CoV-2 Spike protein | SARS-CoV-2 Spike protein |
| ACE2RQ740FcPG191-ACE2RQ740FcPG191 | FcRn, FcRγ-low | SARS-CoV-2 Spike protein | SARS-CoV-2 Spike protein |
| ACE2RQ740FcPG190-ACE2RQ740FcPG190 | FcRn, FcRγ-low | SARS-CoV-2 Spike protein | SARS-CoV-2 Spike protein |
| ACE2RQ740FcPG189-ACE2RQ740FcPG189 | FcRn, FcRγ-low | SARS-CoV-2 Spike protein | SARS-CoV-2 Spike protein |
| ACE2RQ740FcPG188-ACE2RQ740FcPG188 | FcRn, FcRγ-low | SARS-CoV-2 Spike protein | SARS-CoV-2 Spike protein |
| ACE2RQ740FcPG187-ACE2RQ740FcPG187 | FcRn, FcRγ-low | SARS-CoV-2 Spike protein | SARS-CoV-2 Spike protein |
| ACE2RQ740FcPG186-ACE2RQ740FcPG186 | FcRn, FcRγ-low | SARS-CoV-2 Spike protein | SARS-CoV-2 Spike protein |
| ACE2RQ740FcPG185-ACE2RQ740FcPG185 | FcRn, FcRγ-low | SARS-CoV-2 Spike protein | SARS-CoV-2 Spike protein |
| ACE2RQ740FcPG184-ACE2RQ740FcPG184 | FcRn, FcRγ-low | SARS-CoV-2 Spike protein | SARS-CoV-2 Spike protein |

TABLE 18-continued

| Binding domains of Tetrahedral Antibodies | | | |
|---|---|---|---|
| Tetrahedral Antibody | D1/D2 binding specificity | D3/D4 binding specificity | D5/D6 binding specificity |
| ACE2RQ740FcPG183-ACE2RQ740FcPG183 | FcRn, FcRγ-low | SARS-CoV-2 Spike protein | SARS-CoV-2 Spike protein |
| ACE2RQ740FcPGG14-ACE2RQ740FcPGG14 | FcRn, FcRγ-low | SARS-CoV-2 Spike protein | SARS-CoV-2 Spike protein |
| ACE2RQ740FcPGG12-ACE2RQ740FcPGG12 | FcRn, FcRγ-low | SARS-CoV-2 Spike protein | SARS-CoV-2 Spike protein |
| ACE2RQ740FcPGG10-ACE2RQ740FcPGG10 | FcRn, FcRγ-low | SARS-CoV-2 Spike protein | SARS-CoV-2 Spike protein |
| ACE2RQ740FcPGG8-ACE2RQ740FcPGG8 | FcRn, FcRγ-low | SARS-CoV-2 Spike protein | SARS-CoV-2 Spike protein |
| ACE2RQ740FcPGG7-ACE2RQ740FcPGG7 | FcRn, FcRγ-low | SARS-CoV-2 Spike protein | SARS-CoV-2 Spike protein |
| ACE2RQ740FcPGG6-ACE2RQ740FcPGG6 | FcRn, FcRγ-low | SARS-CoV-2 Spike protein | SARS-CoV-2 Spike protein |
| ACE2RQ740FcPGG5-ACE2RQ740FcPGG5 | FcRn, FcRγ-low | SARS-CoV-2 Spike protein | SARS-CoV-2 Spike protein |

NA, not applicable (no appreciable formation)

TABLE 19

| SARS-CoV-2-VSV Virus Inhibition by ACE2 Tetrahedral Antibodies | | | |
|---|---|---|---|
| ACE2 Tetrahedral Antibody | ACE2 DIMER | SARS-CoV-2 (VSV pseudotype) $NT_{50}$ (ug/mL) | VSV-G (VSV control) $NT_{50}$ (ug/mL) |
| ACE2740FcG9-ACE2740FcG9 | | 0.060 | >66.6 |
| | ACE2-740Fc-G9 | 3.12 | >66.6 |
| | ACE2-615Fc-G9 | 13.05 | >66.6 |
| ACE2RQ740FcPG-ACE2RQ740FcPG | | 0.11 | >66.6 |
| | ACE2RQ740FcPG | 3.10 | >66.6 |
| | ACE2RQ615FcPG | 17.56 | >66.6 |

Example 6—Structural Studies of the Superdimeric ACE2 Tetrahedral Antibody

The experiment of FIG. 19 demonstrated the production of a tetrahedral antibody comprising four ACE 2 domains via the superdimerization of four identical ACE2-Fc fusion polypeptide chains, construct ACE2-740FcPG-G9 (SEQ ID NO:81). The superdimerization reaction required the presence of the collectrin-like domain acting as a dimerizing polypeptide (Panel B of FIG. 19); in its absence no tetrahedral antibody was detected (Panel A of FIG. 19). The yield of tetrahedral antibody in this experiment was 27%; in addition, a dimeric form of ACE2-740FcPG-G9 was produced at a level of 64% (FIG. 20, Table 16). SEC-MALS analysis indicated a molar mass of 510 kDa and 257 kDa for the superdimeric and dimeric forms in good agreement with their predicted molecular weights of 438 kDa and 219 kDa, respectively, especially in view of the extensive glycosylation of the ACE2 molecule (FIG. 21, Table 17).

Figure 43:
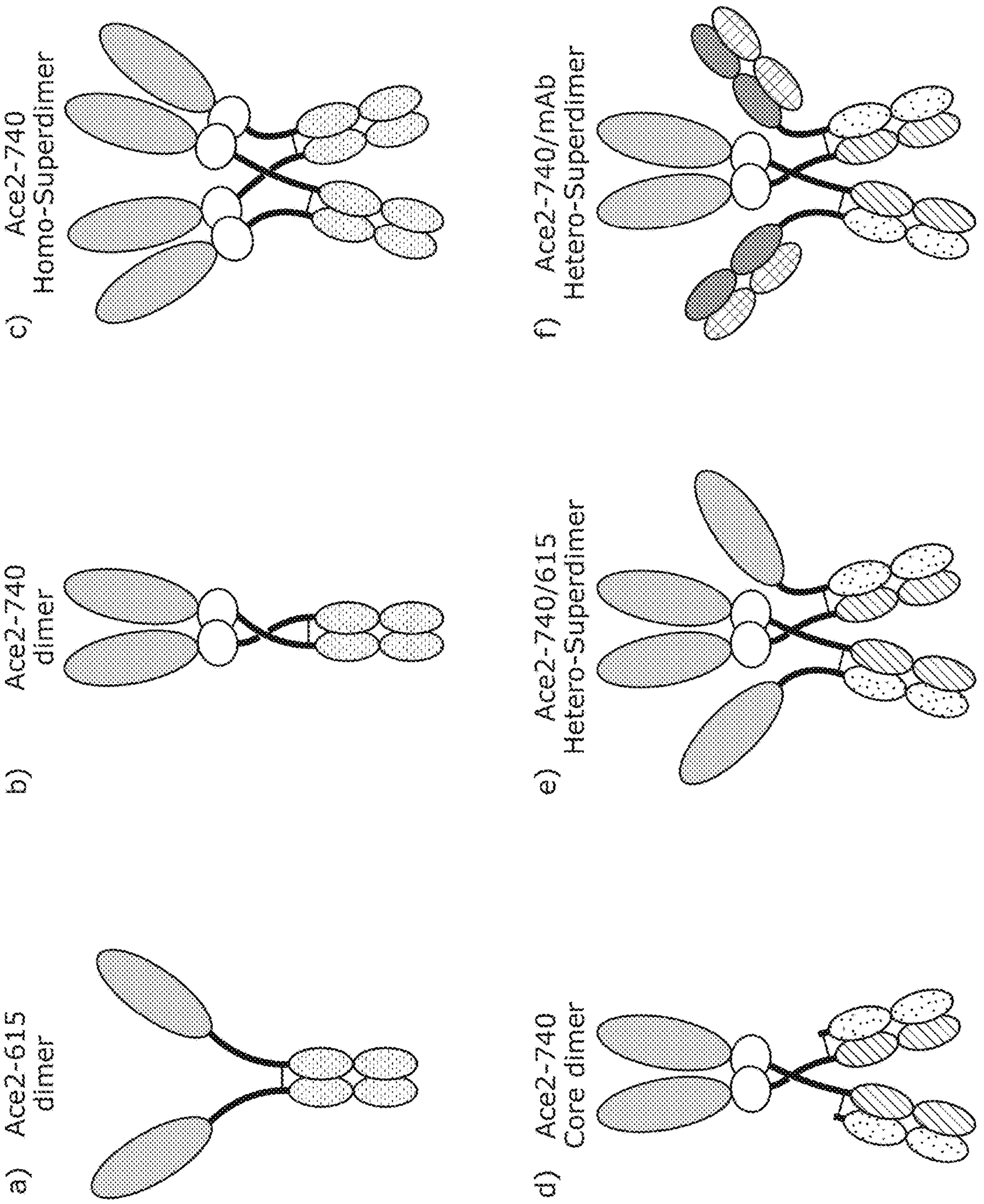
FIG. 43: ACE2 tetrahedral antibodies. Four forms of ACE2 tetrahedral antibodies are shown in panels c, d, e and f. Each comprises domains 1~4 and a dimerizing polypeptide. The structures in panels a and b are standard Fc dimers.

The quaternary structure predicted for the superdimeric ACE2 tetrahedral antibody is shown in part C of FIG. 43. Confirmation of this structure was provided by fragmentation studies carried out with the IdeZ protease which cuts the IgG1 molecule just below the hinge region. Upon digestion with IdeZ (Genovis, Lund, Sweden), followed by reduction of the hinge disulfides with TCEP, both the superdimeric form (part C of FIG. 43) and dimeric form (Part B of FIG. 43) yielded ACE2 dimer as predicted, whereas the monomeric ACE2-Fc fusion protein shown in part A of FIG. 43 (SEQ ID NO:74) yielded only the expected ACE2 monomer.

The superdimer and dimer forms of the ACE2 tetrahedral antibody were readily separated by size exclusion chromatography (FIGS. 20, 21). Following purification, both forms were apparently stable and did not noticeably interconvert over a period of a month, suggesting that the relative formation of the two species had occurred prior to transit from the cell. To determine whether the linker connecting the dimerizing polypeptide to the Fc domain plays a role in the relative abundance of the superdimeric and dimeric forms obtained from the cell supernatant, a series of tetrahedral antibodies was prepared using a series of linkers of varying lengths (Table 15) and the relative yield of superdimer and dimer determined. As summarized in Table 20, the 201 linker consisting of 23 amino acid sequence derived from the stalk region of TNF receptor 1B gave rise to the highest ratio of the superdimeric and dimeric forms, 38%, as well as the lowest levels of high molecular weight (HMW) species, 5.1% (Table 20).

TABLE 20

| Protein ID | Protein name | SEQ ID | Linker length | HMW | SD | D | % SD:D |
|---|---|---|---|---|---|---|---|
| 6-01 | ACE2RQ740FcPG-235 | SEQ ID NO 90 | 57 | 6.2 | 25.4 | 68.0 | 27.2 |
| 6-02 | ACE2RQ740FcPG-212 | SEQ ID NO 91 | 34 | 5.1 | 29.6 | 65.1 | 31.2 |
| 6-03 | ACE2RQ740FcPG-208 | SEQ ID NO 92 | 30 | 3.8 | 33.8 | 62.1 | 35.3 |
| 6-04 | ACE2RQ740FcPG-202 | SEQ ID NO 93 | 24 | 5.3 | 35.8 | 58.7 | 37.8 |
| 6-05 | ACE2RQ740FcPG-201 | SEQ ID NO 94 | 23 | 5.1 | 36.2 | 58.7 | 38.1 |
| 6-06 | ACE2RQ740FcPG-200 | SEQ ID NO 95 | 22 | 7.8 | 34.5 | 57.4 | 37.6 |
| 6-07 | ACE2RQ740FcPG-199 | SEQ ID NO 96 | 21 | 6.2 | 35.2 | 58.4 | 37.6 |
| 6-08 | ACE2RQ740FcPG-198 | SEQ ID NO 97 | 20 | 8.0 | 34.1 | 57.6 | 37.2 |
| 6-09 | ACE2RQ740FcPG-197 | SEQ ID NO 98 | 19 | 8.0 | 33.9 | 57.7 | 37.0 |
| 6-10 | ACE2RQ740FcPG-196 | SEQ ID NO 99 | 18 | 9.5 | 33.4 | 56.9 | 37.0 |
| 6-11 | ACE2RQ740FcPG-195 | SEQ ID NO 100 | 17 | 8.6 | 32.8 | 58.4 | 36.0 |
| 6-12 | ACE2RQ740FcPG-194 | SEQ ID NO 101 | 16 | 6.3 | 34.3 | 59.2 | 36.7 |
| 6-13 | ACE2RQ740FcPG-193 | SEQ ID NO 102 | 15 | 7.9 | 32.1 | 59.7 | 35.0 |
| 6-14 | ACE2RQ740FcPG-192 | SEQ ID NO 103 | 14 | 8.2 | 31.8 | 59.7 | 34.7 |
| 6-15 | ACE2RQ740FcPG-191 | SEQ ID NO 104 | 13 | 7.1 | 33.3 | 59.5 | 35.9 |
| 6-16 | ACE2RQ740FcPG-190 | SEQ ID NO 105 | 12 | 7.5 | 30.4 | 61.8 | 33.0 |
| 6-17 | ACE2RQ740FcPG-189 | SEQ ID NO 106 | 11 | 8.1 | 30.2 | 61.6 | 32.9 |
| 6-18 | ACE2RQ740FcPG-188 | SEQ ID NO 107 | 10 | 7.5 | 30.9 | 61.5 | 33.4 |
| 6-19 | ACE2RQ740FcPG-187 | SEQ ID NO 108 | 9 | 9.3 | 28.8 | 61.7 | 31.9 |
| 6-20 | ACE2RQ740FcPG-186 | SEQ ID NO 109 | 8 | 6.6 | 30.2 | 63.0 | 32.4 |
| 6-21 | ACE2RQ740FcPG-185 | SEQ ID NO 110 | 7 | 6.7 | 27.7 | 65.4 | 29.7 |
| 6-22 | ACE2RQ740FcPG-184 | SEQ ID NO 111 | 6 | 7.4 | 28.2 | 64.1 | 30.6 |
| 6-23 | ACE2RQ740FcPG-183 | SEQ ID NO 112 | 5 | 8.2 | 26.3 | 65.5 | 28.7 |
| 6-24 | ACE2RQ740FcPG-G14 | SEQ ID NO 113 | 14 | 6.5 | 27.8 | 65.4 | 29.8 |
| 6-25 | ACE2RQ740FcPG-G12 | SEQ ID NO 114 | 12 | 15.0 | 29.8 | 54.7 | 35.3 |
| 6-26 | ACE2RQ740FcPG-G10 | SEQ ID NO 115 | 10 | 8.8 | 27.5 | 63.6 | 30.2 |
| | ACE2RQ740FcPG-G9 | SEQ ID NO 78 | 9 | 9.3 | 26.3 | 63.4 | 29.3 |
| | ACE2RQ740FcPG-G9 | SEQ ID NO 78 | 9 | 9.3 | 26.3 | 63.4 | 29.3 |
| | ACE2RQ740Fc-G9 | SEQ ID NO 80 | 9 | 7.8 | 27.0 | 64.1 | 29.6 |
| | ACE2-740FcPG-G9 | SEQ ID NO 79 | 9 | 10.8 | 25.6 | 62.2 | 29.2 |
| | ACE2-740Fc-G9 | SEQ ID NO 81 | 9 | 6.8 | 25.7 | 66.3 | 27.9 |
| 6-27 | ACE2RQ740FcPG-G8 | SEQ ID NO 116 | 8 | 11.3 | 28.8 | 59.7 | 32.6 |
| 6-28 | ACE2RQ740FcPG-G7 | SEQ ID NO 117 | 7 | 11.4 | 29.0 | 59.6 | 32.7 |
| 6-29 | ACE2RQ740FcPG-G6 | SEQ ID NO 118 | 6 | 6.7 | 26.8 | 65.8 | 28.9 |
| 6-30 | ACE2RQ740FcPG-G5 | SEQ ID NO 119 | 5 | 8.5 | 25.6 | 65.7 | 28.1 |

Example 7—Functional Studies of the Superdimeric ACE2 Tetrahedral Antibody

The stoichiometric binding experiments of FIGS. 23-25 demonstrated that when SARS-CoV-2 spike protein is added to mixtures of the ACE2 superdimer and dimer, essentially all of the superdimer is consumed before the dimer begins to bind. This was observed whether the experiment was carried out with the superdimer/dimer mixture produced by cells (FIG. 23) or with a mixture that was prepared using purified and separated superdimer and dimer obtained by size exclusion chromatography (FIG. 24). Similar order-of-binding results were obtained whether the wild-type ACE2 protein or a catalytically inactive ACE2 mutant protein (R273Q) was used in the experiment (compare FIGS. 24 and 25). These results suggested that the ACE2 superdimer binds with much higher affinity than the dimer. SARS-CoV-2 pseudovirus neutralization experiments (FIGS. 27, 28) consistently demonstrated that the ACE2 superdimer is approximately two orders of magnitude more potent than either the ACE2 dimer found in superdimer preparations (FIG. 43, panel b) or an ACE2-Fc dimer lacking the collectrin-like dimerizing polypeptide (FIG. 43, panel a).

Figure 44:
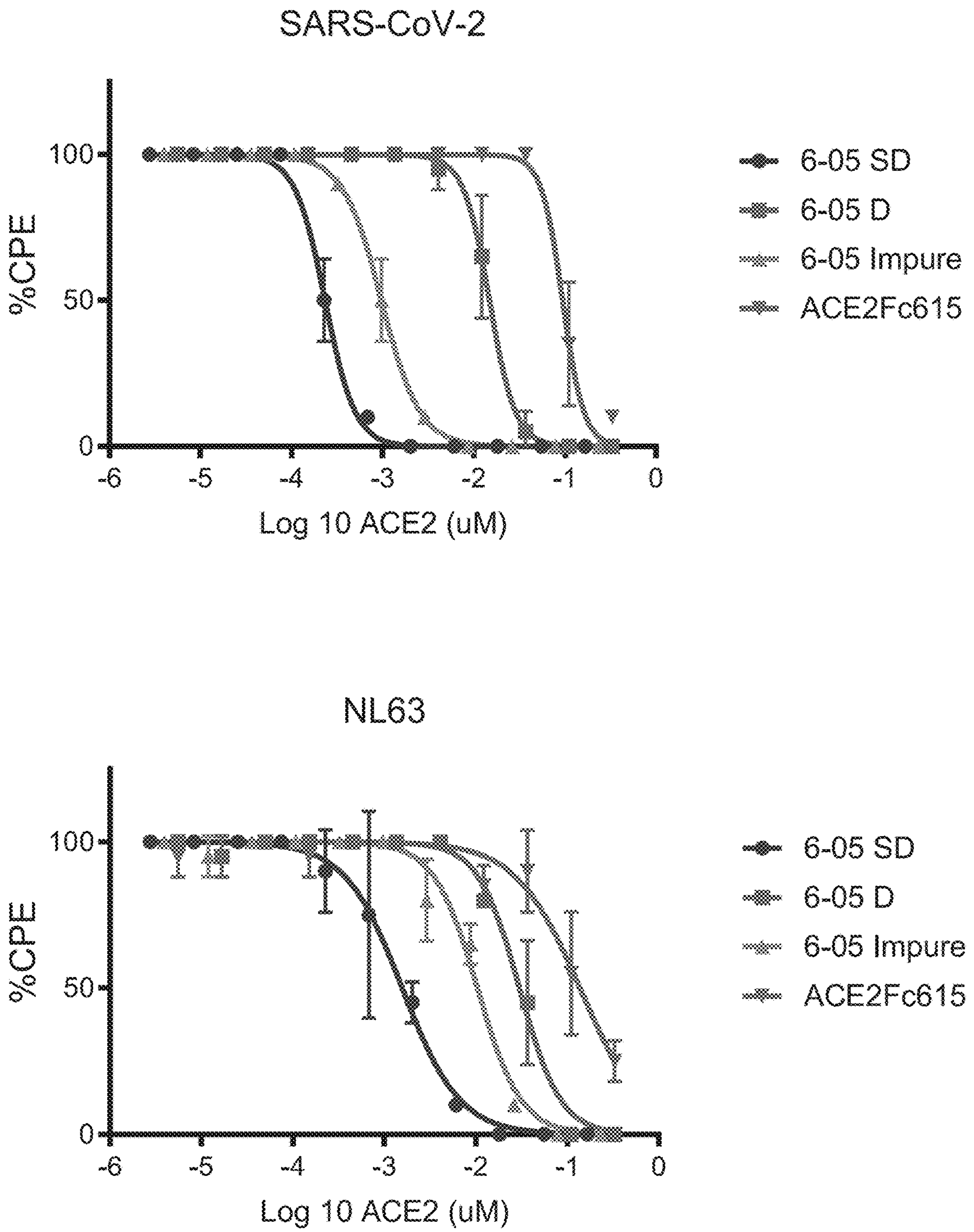
FIG. 44: Relative neutralization activity of ACE2 tetrahedral antibody on live virus. Upper panel: demonstrates neutralization of live SARS-CoV-2 virus. Lower panel: demonstrates neutralization of NL63 (alpha coronavirus). ACE2 superdimer (6-05 SD) neutralizes viruses approximately 3 orders of magnitude better than standard Fc fusion protein (ACE2Fc615). Also show are purified dimer (6-05 D) and an impure mixture of dimer and superdimer (6-05 Impure).
Figure 45:
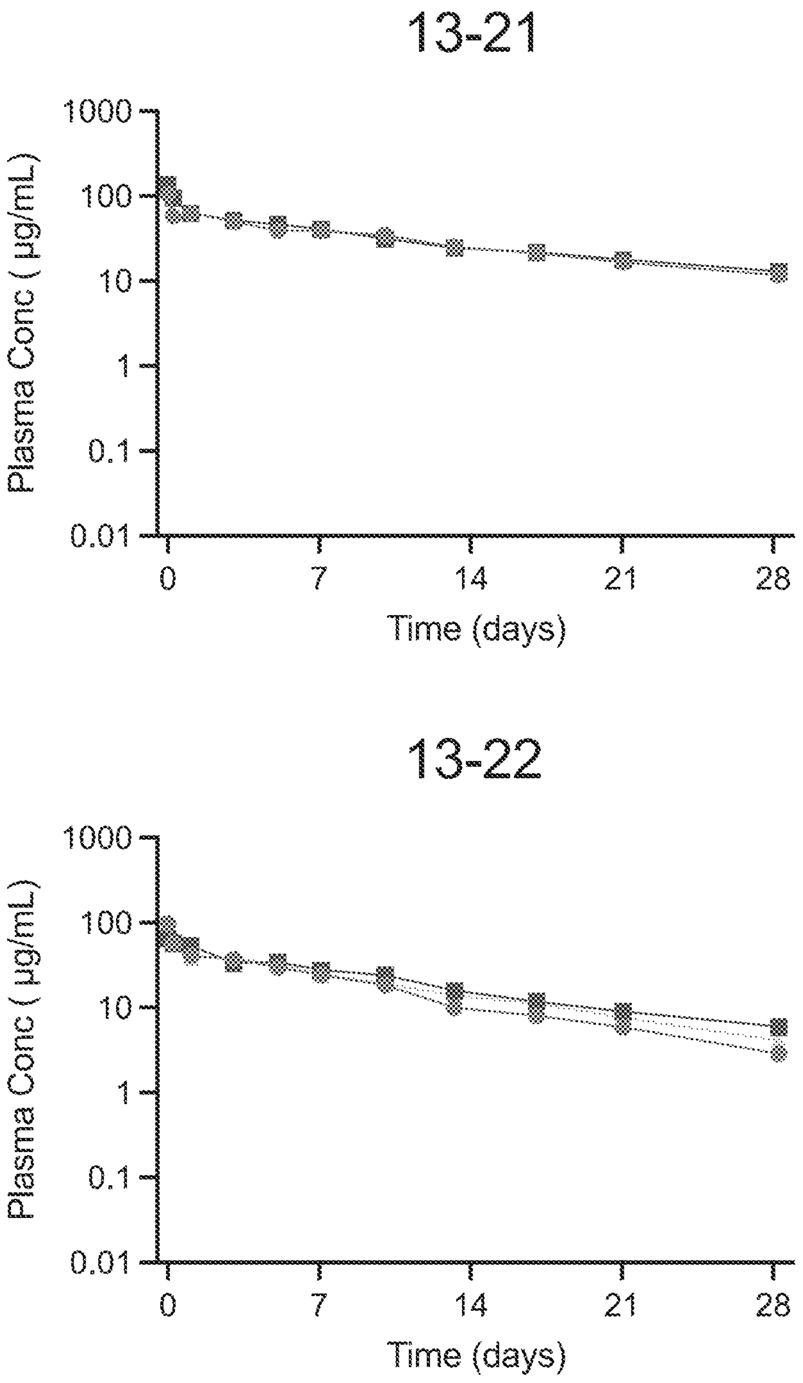
FIG. 45: Pharmacokinetic curves for constructs 13-21 and 13-22. 13-21 corresponds to wt ACE2-B13 superheterodimer tetrahedral antibody. 13-22 corresponds to a mutant ACE2-B13 superheterodimer tetrahedral antibody which has the H378A mutation.
Figure 47:
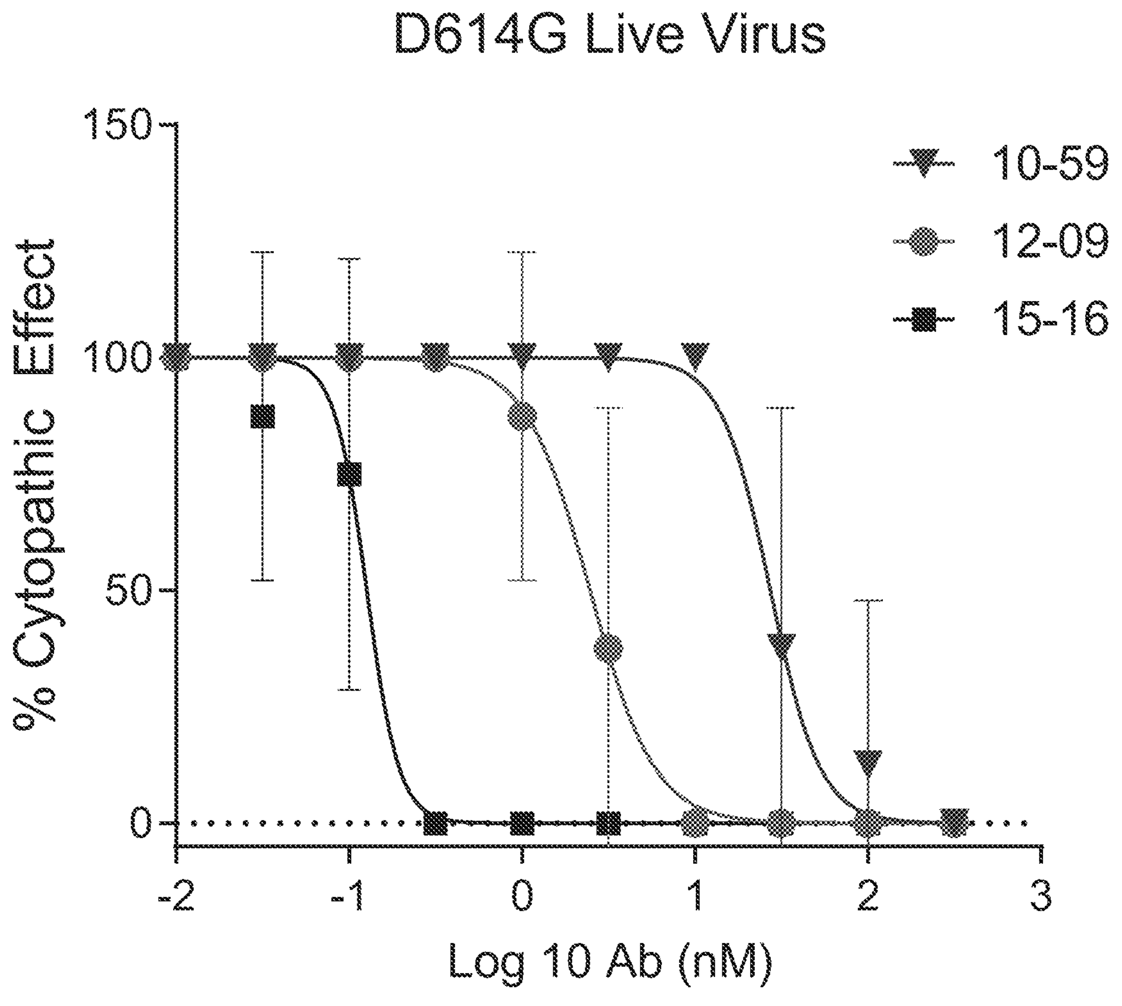
FIG. 47: Relative neutralization activity of ACE2 core dimer (10-59), B-13 (12-09), and ACE2-B-13 superdimer (15-16).

To confirm the biological relevance of the stoichiometric binding and pseudovirus experiments, neutralization assays were carried out with live SARS-CoV-2 virus. These experiments confirmed that the ACE2 is approximately two orders of magnitude more potent in neutralizing virus than the ACE2 dimer, and approximately three orders of magnitude more potent than the ACE2-Fc dimer (FIG. 44). Similar results were obtained in neutralization assay carried out with the NL63 alpha coronavirus which also infects cells through the ACE2 receptor.

Method: Live SARS-Cov-2 neutralization assay. USA-WA1/2020 (NR-52281) and Germany/BavPat1/2020 (NR-52370) were obtained from BEI Resources, Manassas, VA and expanded using a single passage in Vero/TMPRSS2. Virus was end-point titrated in Vero/TMPRSS2 and 100 $TCID_{50}$ used per well. Virus was pre-incubated for 1 hour at 37° C. with serial dilutions of antibody and then plated in replicates of 8 on Vero/TMPRSS2 cells. After 7 days wells were scored for cytopathic effect.

TABLE 21

| | EC50 (nM) Live Virus Neutralization | | | |
|---|---|---|---|---|
| Protein ID | SARS-CoV-2 | Fold Increase | NL63 | Fold Increase |
| 6-05 Superdimer | 0.233 | 403.7 | 1.58 | 86.5 |
| 6-05 Dimer | 0.970 | 96.9 | 10.43 | 13.1 |
| 6-05 Impure | 14.87 | 6.3 | 29.94 | 4.6 |
| ACE2Fc615 | 93.95 | 1.0 | 136.50 | 1.0 |

Example 8—Engineering ACE 2 Super-Heterodimeric Tetrahedral Antibodies

As linker optimization alone did not overcome the apparent structural constraints that limited the yield of superdimeric ACE2 tetrahedral antibody, a series of constructs was generated with the predicted structure shown in part E of FIG. 43 (Table 22). This structure, termed "super-heterodimer", differs from the "super-homodimer shown in Part C of FIG. 43 by having one pair instead of two pair of dimerizing polypeptides. It was reasoned that the super-heterodimer would have the advantage of greater conformational flexibility by limiting superdimerization to one of the heavy chains. This prediction was borne out; by independently varying the linker length on the H1 and H2 chains, the ACE2 super-heterodimer was obtained in yields as high as 98.8% from culture supernatant (Table 23).

TABLE 22

| Protein ID | Protein name | Domain Type D3/D4/D5/D6 | H1 Chain | H2 Chain |
|---|---|---|---|---|
| SEQ IDs Used for the Preparation of Hetero-Superdimeric Tetrahedral Antibodies | | | | |
| 5-01 | ACE2FcPGRF-740RQ186/615RQ201 | ACE2 R273Q | SEQ ID NO: 338 | SEQ ID NO: 342 |
| 5-02 | ACE2FcPGRF-740RQ186/615RQ202 | ACE2 R273Q | SEQ ID NO: 338 | SEQ ID NO: 343 |
| 5-03 | ACE2FcPGRF-740RQ186/615RQ208 | ACE2 R273Q | SEQ ID NO: 338 | SEQ ID NO: 344 |
| 5-04 | ACE2FcPGRF-740RQ186/615RQ212 | ACE2 R273Q | SEQ ID NO: 338 | SEQ ID NO: 345 |
| 5-05 | ACE2FcPGRF-740RQ186/615RQ213 | ACE2 R273Q | SEQ ID NO: 338 | SEQ ID NO: 346 |
| 5-06 | ACE2FcPGRF-740RQ186/615RQ216 | ACE2 R273Q | SEQ ID NO: 338 | SEQ ID NO: 347 |
| 5-07 | ACE2FcPGRF-740RQ186/615RQ217 | ACE2 R273Q | SEQ ID NO: 338 | SEQ ID NO: 348 |
| 5-08 | ACE2FcPGRF-740RQ186/615RQ218 | ACE2 R273Q | SEQ ID NO: 338 | SEQ ID NO: 349 |
| 5-09 | ACE2FcPGRF-740RQ186/615RQ224 | ACE2 R273Q | SEQ ID NO: 338 | SEQ ID NO: 350 |
| 5-10 | ACE2FcPGRF-740RQ186/615RQ235 | ACE2 R273Q | SEQ ID NO: 338 | SEQ ID NO: 351 |
| 5-11 | ACE2FcPGRF-740RQ194/615RQ201 | ACE2 R273Q | SEQ ID NO: 339 | SEQ ID NO: 342 |
| 5-12 | ACE2FcPGRF-740RQ194/615RQ202 | ACE2 R273Q | SEQ ID NO: 339 | SEQ ID NO: 343 |
| 5-13 | ACE2FcPGRF-740RQ194/615RQ208 | ACE2 R273Q | SEQ ID NO: 339 | SEQ ID NO: 344 |
| 5-14 | ACE2FcPGRF-740RQ194/615RQ212 | ACE2 R273Q | SEQ ID NO: 339 | SEQ ID NO: 345 |
| 5-15 | ACE2FcPGRF-740RQ194/615RQ213 | ACE2 R273Q | SEQ ID NO: 339 | SEQ ID NO: 346 |
| 5-16 | ACE2FcPGRF-740RQ194/615RQ216 | ACE2 R273Q | SEQ ID NO: 339 | SEQ ID NO: 347 |
| 5-17 | ACE2FcPGRF-740RQ194/615RQ217 | ACE2 R273Q | SEQ ID NO: 339 | SEQ ID NO: 348 |
| 5-18 | ACE2FcPGRF-740RQ194/615RQ218 | ACE2 R273Q | SEQ ID NO: 339 | SEQ ID NO: 349 |
| 5-19 | ACE2FcPGRF-740RQ194/615RQ224 | ACE2 R273Q | SEQ ID NO: 339 | SEQ ID NO: 350 |
| 5-20 | ACE2FcPGRF-740RQ194/615RQ235 | ACE2 R273Q | SEQ ID NO: 339 | SEQ ID NO: 351 |
| 5-21 | ACE2FcPGRF-740RQ201/615RQ201 | ACE2 R273Q | SEQ ID NO: 340 | SEQ ID NO: 342 |
| 5-22 | ACE2FcPGRF-740RQ201/615RQ202 | ACE2 R273Q | SEQ ID NO: 340 | SEQ ID NO: 343 |
| 5-23 | ACE2FcPGRF-740RQ201/615RQ208 | ACE2 R273Q | SEQ ID NO: 340 | SEQ ID NO: 344 |
| 5-24 | ACE2FcPGRF-740RQ201/615RQ212 | ACE2 R273Q | SEQ ID NO: 340 | SEQ ID NO: 345 |
| 5-25 | ACE2FcPGRF-740RQ201/615RQ213 | ACE2 R273Q | SEQ ID NO: 340 | SEQ ID NO: 346 |
| 5-26 | ACE2FcPGRF-740RQ201/615RQ216 | ACE2 R273Q | SEQ ID NO: 340 | SEQ ID NO: 347 |
| 5-27 | ACE2FcPGRF-740RQ201/615RQ217 | ACE2 R273Q | SEQ ID NO: 340 | SEQ ID NO: 348 |
| 5-28 | ACE2FcPGRF-740RQ201/615RQ218 | ACE2 R273Q | SEQ ID NO: 340 | SEQ ID NO: 349 |
| 5-29 | ACE2FcPGRF-740RQ201/615RQ224 | ACE2 R273Q | SEQ ID NO: 340 | SEQ ID NO: 350 |
| 5-30 | ACE2FcPGRF-740RQ201/615RQ235 | ACE2 R273Q | SEQ ID NO: 341 | SEQ ID NO: 351 |
| 5-31 | ACE2FcPGRF-740RQ208/615RQ201 | ACE2 R273Q | SEQ ID NO: 341 | SEQ ID NO: 342 |
| 5-32 | ACE2FcPGRF-740RQ208/615RQ202 | ACE2 R273Q | SEQ ID NO: 341 | SEQ ID NO: 343 |
| 5-33 | ACE2FcPGRF-740RQ208/615RQ208 | ACE2 R273Q | SEQ ID NO: 341 | SEQ ID NO: 344 |
| 5-34 | ACE2FcPGRF-740RQ208/615RQ212 | ACE2 R273Q | SEQ ID NO: 341 | SEQ ID NO: 345 |
| 5-35 | ACE2FcPGRF-740RQ208/615RQ213 | ACE2 R273Q | SEQ ID NO: 341 | SEQ ID NO: 346 |
| 5-36 | ACE2FcPGRF-740RQ208/615RQ216 | ACE2 R273Q | SEQ ID NO: 341 | SEQ ID NO: 347 |
| 5-37 | ACE2FcPGRF-740RQ208/615RQ217 | ACE2 R273Q | SEQ ID NO: 341 | SEQ ID NO: 348 |
| 5-38 | ACE2FcPGRF-740RQ208/615RQ218 | ACE2 R273Q | SEQ ID NO: 341 | SEQ ID NO: 349 |
| 5-39 | ACE2FcPGRF-740RQ208/615RQ224 | ACE2 R273Q | SEQ ID NO: 341 | SEQ ID NO: 350 |
| 5-40 | ACE2FcPGRF-740RQ208/615RQ235 | ACE2 R273Q | SEQ ID NO: 341 | SEQ ID NO: 351 |

TABLE 23

| Protein ID | H1 Chain Linker | H2 Chain Linker | Dimerizing Polypeptide Pair D3/D4 | HMW (%) | Main Peak (%) | Retention Time (min) |
|---|---|---|---|---|---|---|
| 5-01 | 186 | 201 | Collectrin-like | 28.7 | 71.3 | 21.41 |
| 5-02 | 186 | 202 | Collectrin-like | 30.9 | 69.1 | 21.37 |
| 5-03 | 186 | 208 | Collectrin-like | 5.1 | 81.6 | 21.25 |
| 5-04 | 186 | 212 | Collectrin-like | 20.3 | 79.7 | 21.22 |
| 5-05 | 186 | 213 | Collectrin-like | 21.2 | 78.8 | 21.19 |
| 5-06 | 186 | 216 | Collectrin-like | 17.9 | 82.1 | 21.16 |
| 5-07 | 186 | 217 | Collectrin-like | 24.3 | 75.7 | 21.11 |
| 5-08 | 186 | 218 | Collectrin-like | 25.1 | 74.9 | 21.11 |
| 5-09 | 186 | 224 | Collectrin-like | 42.0 | 58.0 | 21.04 |
| 5-10 | 186 | 235 | Collectrin-like | 26.3 | 73.7 | 20.98 |
| 5-11 | 194 | 201 | Collectrin-like | 24.7 | 75.3 | 21.29 |
| 5-12 | 194 | 202 | Collectrin-like | 16.2 | 83.8 | 21.29 |
| 5-13 | 194 | 208 | Collectrin-like | 8.5 | 91.5 | 21.19 |
| 5-14 | 194 | 212 | Collectrin-like | 19.0 | 81.0 | 20.95 |
| 5-15 | 194 | 213 | Collectrin-like | 18.3 | 81.7 | 21.00 |
| 5-16 | 194 | 216 | Collectrin-like | 32.0 | 68.0 | 20.91 |
| 5-17 | 194 | 217 | Collectrin-like | 27.4 | 72.6 | 20.92 |
| 5-18 | 194 | 218 | Collectrin-like | 45.8 | 53.9 | 20.84 |
| 5-19 | 194 | 224 | Collectrin-like | 21.6 | 78.4 | 20.83 |
| 5-20 | 194 | 235 | Collectrin-like | 46.3 | 53.6 | 20.67 |
| 5-21 | 201 | 201 | Collectrin-like | 1.2 | 98.8 | 21.55 |
| 5-22 | 201 | 202 | Collectrin-like | 4.1 | 95.9 | 21.47 |
| 5-23 | 201 | 208 | Collectrin-like | 4.0 | 95.9 | 21.39 |
| 5-24 | 201 | 212 | Collectrin-like | 3.3 | 96.7 | 21.34 |

TABLE 23-continued

| Protein ID | H1 Chain Linker | H2 Chain Linker | Dimerizing Polypeptide Pair D3/D4 | HMW (%) | Main Peak (%) | Retention Time (min) |
|---|---|---|---|---|---|---|
| 5-25 | 201 | 213 | Collectrin-like | 4.7 | 95.3 | 21.32 |
| 5-26 | 201 | 216 | Collectrin-like | 4.7 | 95.3 | 21.28 |
| 5-27 | 201 | 217 | Collectrin-like | 4.0 | 96.0 | 20.96 |
| 5-28 | 201 | 218 | Collectrin-like | 7.5 | 92.5 | 20.96 |
| 5-29 | 201 | 224 | Collectrin-like | 11.1 | 88.7 | 21.30 |
| 5-30 | 201 | 235 | Collectrin-like | 4.9 | 95.1 | 21.16 |
| 5-31 | 208 | 201 | Collectrin-like | 4.0 | 95.8 | 21.39 |
| 5-32 | 208 | 202 | Collectrin-like | 10.7 | 89.2 | 21.36 |
| 5-33 | 208 | 208 | Collectrin-like | 11.0 | 89.0 | 21.32 |
| 5-34 | 208 | 212 | Collectrin-like | 4.6 | 95.4 | 21.25 |
| 5-35 | 208 | 213 | Collectrin-like | 3.2 | 96.7 | 21.26 |
| 5-36 | 208 | 216 | Collectrin-like | 19.3 | 73.6 | 21.25 |
| 5-37 | 208 | 217 | Collectrin-like | 22.9 | 76.3 | 21.21 |
| 5-38 | 208 | 218 | Collectrin-like | 14.5 | 85.5 | 21.18 |
| 5-39 | 208 | 224 | Collectrin-like | 15.0 | 84.9 | 21.16 |
| 5-40 | 208 | 235 | Collectrin-like | 16.7 | 75.5 | 21.10 |

Example 9—Viral Neutralizing Activity of ACE2 Super-Heterodimeric Tetrahedral Antibody Live virus neutralization studies confirmed that the super-heterodimer retained the exquisite potency of the super-homodimer in neutralizing both the SARS-CoV-2 beta coronavirus and the NL63 alpha coronavirus. (Table 24).

TABLE 24

| Protein ID | Tetrahedral Antibody Type | No. of Dimerizing Polypeptide Pairs | H Chain | H1 Chain | H2 Chain | EC50 (nM) SARS-CoV-2 | NL63 |
|---|---|---|---|---|---|---|---|
| 6-05 | Super-homodimer | 2 | 201 | N/A | N/A | 0.4610 | 10.20 |
| 5-21 | Super-heterodimer | 1 | N/A | 201 | 201 | 0.9421 | 7.688 |
| 5-27 | Super-heterodimer | 1 | N/A | 201 | 217 | 0.9556 | 4.160 |
| 5-28 | Super-heterodimer | 1 | N/A | 201 | 218 | 1.276 | 10.05 |
| 5-34 | Super-heterodimer | 1 | N/A | 208 | 212 | 0.6933 | 3.687 |
| 5-37 | Super-heterodimer | 1 | N/A | 208 | 217 | 0.8348 | 5.400 |

Example 10—ACE2 Mutants

In the course of these investigations, the R273Q mutation was evaluated as a means to render ACE2 enzymatically active to avoid possible complications associated with clinical use of the active enzyme in SARS Co-V-2 patients. It was discovered that R273Q had a severe effect on the plasma half-life of ACE2. Accordingly, five new mutations, R273A, R293G, R273C, H378A and E402A, were generated and evaluated in several ACE2 constructs (Tables 25A, 25B and 26A). The effect of the mutations on carboxypeptidase was consistent among different was consistent among the various constructs. It was determined that H378A was the best tolerated with respect to half-life and provided for the greatest reduction in enzyme activity.

The H378A mutation decreased the level of ACE2 carboxypeptidase activity by 99.95% with angiotensin-II, 99.93% with bradykinin and 99.85% with apelin-13 (in Table 26B).

Materials: Angiotensin II peptide (AS-20633), Des-Arg9-bradykinin peptide (AS-65642) (AnaSpec, Fremont, CA), Apelin-13 peptide (APEL-003) (CPC Scientific, San Jose, CA). Recombinant human ACE2 (79200) (BioLegend, San Diego, CA) was used as a positive control. Phenylalanine assay kits (ab83376) (Abcam, Cambridge, UK).

Methods: ACE2 carboxypeptidase activity was quantified using the presence of phenylalanine. The carboxypeptidase reaction was initiated when 0.025 μg (wild-type) or 15 μg (ACE2 mutant) of COVICEPT was added to 0.2 μM angiotensin II, bradykinin or apelin-13 in the presence of the reaction buffer (PBS with 10 μM ZnCl2) at 37° C. Twenty microliter aliquots were taken out from the reaction mixture every 2 minutes up to 20 minutes and heat inactivated at 80° C. for 5 minutes. The amount of phenylalanine in the heat inactivated aliquots was quantified using the phenylalanine assay kit.

TABLE 25A

| Protein ID | Protein Name | H1 Chain | H2 Chain |
|---|---|---|---|
| 10-01 | ACE2FcPGRF-740wt201/615wt201 | SEQ ID NO: 354 | SEQ ID NO: 366 |
| 10-02 | ACE2FcPGRF-740RA201/615RA201 | SEQ ID NO: 355 | SEQ ID NO: 367 |
| 10-03 | ACE2FcPGRF-740RG201/615RG201 | SEQ ID NO: 356 | SEQ ID NO: 368 |
| 10-04 | ACE2FcPGRF-740RV201/615RV201 | SEQ ID NO: 357 | SEQ ID NO: 369 |
| 10-05 | ACE2FcPGRF-740HA201/615HA201 | SEQ ID NO: 358 | SEQ ID NO: 370 |
| 10-06 | ACE2FcPGRF-740EA201/615EA201 | SEQ ID NO: 359 | SEQ ID NO: 371 |
| 10-07 | ACE2FcPGRF-740wt201/615wt208 | SEQ ID NO: 354 | SEQ ID NO: 372 |
| 10-08 | ACE2FcPGRF-740RA201/615RA208 | SEQ ID NO: 355 | SEQ ID NO: 373 |
| 10-09 | ACE2FcPGRF-740RG201/615RG208 | SEQ ID NO: 356 | SEQ ID NO: 374 |
| 10-10 | ACE2FcPGRF-740RV201/615RV208 | SEQ ID NO: 357 | SEQ ID NO: 375 |
| 10-11 | ACE2FcPGRF-740HA201/615HA208 | SEQ ID NO: 358 | SEQ ID NO: 376 |
| 10-12 | ACE2FcPGRF-740EA201/615EA208 | SEQ ID NO: 359 | SEQ ID NO: 377 |
| 10-13 | ACE2FcPGRF-740wt208/615wt201 | SEQ ID NO: 360 | SEQ ID NO: 366 |
| 10-14 | ACE2FcPGRF-740RA208/615RA201 | SEQ ID NO: 361 | SEQ ID NO: 367 |
| 10-15 | ACE2FcPGRF-740RG208/615RG201 | SEQ ID NO: 362 | SEQ ID NO: 368 |
| 10-16 | ACE2FcPGRF-740RV208/615RV201 | SEQ ID NO: 363 | SEQ ID NO: 369 |
| 10-17 | ACE2FcPGRF-740HA208/615HA201 | SEQ ID NO: 364 | SEQ ID NO: 370 |
| 10-18 | ACE2FcPGRF-740EA208/615EA201 | SEQ ID NO: 365 | SEQ ID NO: 371 |
| 10-19 | ACE2FcPGRF-740wt208/615wt212 | SEQ ID NO: 360 | SEQ ID NO: 378 |
| 10-20 | ACE2FcPGRF-740RA208/615RA212 | SEQ ID NO: 361 | SEQ ID NO: 379 |
| 10-21 | ACE2FcPGRF-740RG208/615RG212 | SEQ ID NO: 362 | SEQ ID NO: 380 |
| 10-22 | ACE2FcPGRF-740RV208/615RV212 | SEQ ID NO: 363 | SEQ ID NO: 381 |
| 10-23 | ACE2FcPGRF-740HA208/615HA212 | SEQ ID NO: 364 | SEQ ID NO: 382 |
| 10-24 | ACE2FcPGRF-740EA208/615EA212 | SEQ ID NO: 365 | SEQ ID NO: 383 |
| 10-25 | ACE2FcPGRF-740wt201/615wt201/TMEM27CA | SEQ ID NO: 354 | SEQ ID NO: 384 |
| 10-26 | ACE2FcPGRF-740RA201/615RA201/TMEM27CA | SEQ ID NO: 355 | SEQ ID NO: 385 |
| 10-27 | ACE2FcPGRF-740RG201/615RG201/TMEM27CA | SEQ ID NO: 356 | SEQ ID NO: 386 |
| 10-28 | ACE2FcPGRF-740RV201/615RV201/TMEM27CA | SEQ ID NO: 357 | SEQ ID NO: 387 |
| 10-29 | ACE2FcPGRF-740HA201/615HA201/TMEM27CA | SEQ ID NO: 358 | SEQ ID NO: 388 |
| 10-30 | ACE2FcPGRF-740EA201/615EA201/TMEM27CA | SEQ ID NO: 359 | SEQ ID NO: 389 |
| 10-31 | ACE2FcPGRF-740wt20l/607wt201/TMEM27 | SEQ ID NO: 354 | SEQ ID NO: 390 |
| 10-32 | ACE2FcPGRF-740RA201/607RA201/TMEM27 | SEQ ID NO: 355 | SEQ ID NO: 391 |
| 10-33 | ACE2FcPGRF-740RG201/607RG201/TMEM27 | SEQ ID NO: 356 | SEQ ID NO: 392 |
| 10-34 | ACE2FcPGRF-740RV201/607RV201/TMEM27 | SEQ ID NO: 357 | SEQ ID NO: 393 |

TABLE 25A-continued

| Protein ID | Protein Name | H1 Chain | H2 Chain |
|---|---|---|---|
| 10-35 | ACE2FcPGRF-740HA201/607HA201/TMEM27 | SEQ ID NO: 358 | SEQ ID NO: 394 |
| 10-36 | ACE2FcPGRF-740EA201/607EA201/TMEM27 | SEQ ID NO: 359 | SEQ ID NO: 395 |
| 10-37 | ACE2FcPGRF-740wt201/611wt201/TMEM27 | SEQ ID NO: 354 | SEQ ID NO: 396 |
| 10-38 | ACE2FcPGRF-740RA201/611RA201/TMEM27 | SEQ ID NO: 355 | SEQ ID NO: 397 |
| 10-39 | ACE2FcPGRF-740RG201/611RG201/TMEM27 | SEQ ID NO: 356 | SEQ ID NO: 398 |
| 10-40 | ACE2FcPGRF-740RV201/611RV201/TMEM27 | SEQ ID NO: 357 | SEQ ID NO: 399 |
| 10-41 | ACE2FcPGRF-740HA201/611HA201/TMEM27 | SEQ ID NO: 358 | SEQ ID NO: 400 |
| 10-42 | ACE2FcPGRF-740EA201/611EA201/TMEM27 | SEQ ID NO: 359 | SEQ ID NO: 401 |

TABLE 25B

| Protein ID | Protein Name | H1 Chain | Fc Chain | ACE2 Mutations |
|---|---|---|---|---|
| 10-43 | ACE2FcPGRF-740wt201 | SEQ ID NO: 402 | | |
| 10-44 | ACE2FcPGRF-740RA201 | SEQ ID NO: 403 | | |
| 10-45 | ACE2FcPGRF-740RG201 | SEQ ID NO: 404 | | |
| 10-46 | ACE2FcPGRF-740RV201 | SEQ ID NO: 405 | | |
| 10-47 | ACE2FcPGRF-740HA201 | SEQ ID NO: 406 | | |
| 10-48 | ACE2FcPGRF-740EA201 | SEQ ID NO: 407 | | |
| 10-49 | ACE2FcPGRF-740wt201/313 | SEQ ID NO: 408 | | K31F/N33D/H34S/E35Q |
| 10-50 | ACE2FcPGRF-740RA201/313 | SEQ ID NO: 409 | | K31F/N33D/H34S/E35Q |
| 10-51 | ACE2FcPGRF-740RG201/313 | SEQ ID NO: 410 | | K31F/N33D/H34S/E35Q |
| 10-52 | ACE2FcPGRF-740RV201/313 | SEQ ID NO: 411 | | K31F/N33D/H34S/E35Q |
| 10-53 | ACE2FcPGRF-740HA201/313 | SEQ ID NO: 412 | | K31F/N33D/H34S/E35Q |
| 10-54 | ACE2FcPGRF-740EA201/313 | SEQ ID NO: 413 | | K31F/N33D/H34S/E35Q |
| 10-55 | ACE2c60PGRF-740wt208 | SEQ ID NO: 360 | SEQ ID NO: 420 | |
| 10-56 | ACE2c60PGRF-740RA208 | SEQ ID NO: 361 | SEQ ID NO: 420 | |
| 10-57 | ACE2c60PGRF-740RG208 | SEQ ID NO: 362 | SEQ ID NO: 420 | |
| 10-58 | ACE2c60PGRF-740RV208 | SEQ ID NO: 363 | SEQ ID NO: 420 | |
| 10-59 | ACE2c60PGRF-740HA208 | SEQ ID NO: 364 | SEQ ID NO: 420 | |
| 10-60 | ACE2c60PGRF-740EA208 | SEQ ID NO: 365 | SEQ ID NO: 420 | |
| 10-61 | ACE2c60PGRF-740wt208/313 | SEQ ID NO: 414 | SEQ ID NO: 420 | K31F/N33D/H34S/E35Q |
| 10-62 | ACE2c60PGRF-740RA208/313 | SEQ ID NO: 415 | SEQ ID NO: 420 | K31F/N33D/H34S/E35Q |
| 10-63 | ACE2c60PGRF-740RG208/313 | SEQ ID NO: 416 | SEQ ID NO: 420 | K31F/N33D/H34S/E35Q |
| 10-64 | ACE2c60PGRF-740RV208/313 | SEQ ID NO: 417 | SEQ ID NO: 420 | K31F/N33D/H34S/E35Q |
| 10-65 | ACE2c60PGRF-740HA208/313 | SEQ ID NO: 418 | SEQ ID NO: 420 | K31F/N33D/H34S/E35Q |
| 10-66 | ACE2c60PGRF-740EA208/313 | SEQ ID NO: 419 | SEQ ID NO: 420 | K31F/N33D/H34S/E35Q |

TABLE 26A

| Protein ID | Domain Type D3/D4 | Domain Type D5/D6 | First Dimerizing Polypeptide Pair D3/D4 | First Dimerizing Polypeptide Sequence | Second Dimerizing Polypeptide Pair D5/D6 | Second Dimerizing Polypeptide Sequence |
|---|---|---|---|---|---|---|
| 10-01 | ACE2 wt | ACE2 wt | Collectrin-like | SEQ ID NO: 782 | | |
| 10-02 | ACE2 R273A | ACE2 R273A | Collectrin-like | SEQ ID NO: 782 | | |
| 10-03 | ACE2 R273G | ACE2 R273G | Collectrin-like | SEQ ID NO: 782 | | |
| 10-04 | ACE2 R273V | ACE2 R273V | Collectrin-like | SEQ ID NO: 782 | | |
| 10-05 | ACE2 H378A | ACE2 H378A | Collectrin-like | SEQ ID NO: 782 | | |
| 10-06 | ACE2 E201A | ACE2 E201A | Collectrin-like | SEQ ID NO: 782 | | |
| 10-07 | ACE2 wt | ACE2 wt | Collectrin-like | SEQ ID NO: 782 | | |
| 10-08 | ACE2 R273A | ACE2 R273A | Collectrin-like | SEQ ID NO: 782 | | |
| 10-09 | ACE2 R273G | ACE2 R273G | Collectrin-like | SEQ ID NO: 782 | | |
| 10-10 | ACE2 R273V | ACE2 R273V | Collectrin-like | SEQ ID NO: 782 | | |
| 10-11 | ACE2 H378A | ACE2 H378A | Collectrin-like | SEQ ID NO: 782 | | |
| 10-12 | ACE2 E201A | ACE2 E201A | Collectrin-like | SEQ ID NO: 782 | | |
| 10-13 | ACE2 wt | ACE2 wt | Collectrin-like | SEQ ID NO: 782 | | |
| 10-14 | ACE2 R273A | ACE2 R273A | Collectrin-like | SEQ ID NO: 782 | | |
| 10-15 | ACE2 R273G | ACE2 R273G | Collectrin-like | SEQ ID NO: 782 | | |
| 10-16 | ACE2 R273V | ACE2 R273V | Collectrin-like | SEQ ID NO: 782 | | |
| 10-17 | ACE2 H378A | ACE2 H378A | Collectrin-like | SEQ ID NO: 782 | | |
| 10-18 | ACE2 E201A | ACE2 E201A | Collectrin-like | SEQ ID NO: 782 | | |
| 10-19 | ACE2 wt | ACE2 wt | Collectrin-like | SEQ ID NO: 782 | | |
| 10-20 | ACE2 R273A | ACE2 R273A | Collectrin-like | SEQ ID NO: 782 | | |
| 10-21 | ACE2 R273G | ACE2 R273G | Collectrin-like | SEQ ID NO: 782 | | |
| 10-22 | ACE2 R273V | ACE2 R273V | Collectrin-like | SEQ ID NO: 782 | | |
| 10-23 | ACE2 H378A | ACE2 H378A | Collectrin-like | SEQ ID NO: 782 | | |
| 10-24 | ACE2 E201A | ACE2 E201A | Collectrin-like | SEQ ID NO: 782 | | |

TABLE 26A-continued

| Protein ID | Domain Type D3/D4 | Domain Type D5/D6 | First Dimerizing Polypeptide Pair D3/D4 | First Dimerizing Polypeptide Sequence | Second Dimerizing Polypeptide Pair D5/D6 | Second Dimerizing Polypeptide Sequence |
|---|---|---|---|---|---|---|
| 10-25 | ACE2 wt | ACE2 wt | Collectrin-like | SEQ ID NO: 782 | Collectrin | SEQ ID NO: 784 |
| 10-26 | ACE2 R273A | ACE2 R273A | Collectrin-like | SEQ ID NO: 782 | Collectrin | SEQ ID NO: 784 |
| 10-27 | ACE2 R273G | ACE2 R273G | Collectrin-like | SEQ ID NO: 782 | Collectrin | SEQ ID NO: 784 |
| 10-28 | ACE2 R273V | ACE2 R273V | Collectrin-like | SEQ ID NO: 782 | Collectrin | SEQ ID NO: 784 |
| 10-29 | ACE2 H378A | ACE2 H378A | Collectrin-like | SEQ ID NO: 782 | Collectrin | SEQ ID NO: 784 |
| 10-30 | ACE2 E201A | ACE2 E201A | Collectrin-like | SEQ ID NO: 782 | Collectrin | SEQ ID NO: 784 |
| 10-31 | ACE2 wt | ACE2 wt | Collectrin-like | SEQ ID NO: 782 | Collectrin | SEQ ID NO: 783 |
| 10-32 | ACE2 R273A | ACE2 R273A | Collectrin-like | SEQ ID NO: 782 | Collectrin | SEQ ID NO: 783 |
| 10-33 | ACE2 R273G | ACE2 R273G | Collectrin-like | SEQ ID NO: 782 | Collectrin | SEQ ID NO: 783 |
| 10-34 | ACE2 R273V | ACE2 R273V | Collectrin-like | SEQ ID NO: 782 | Collectrin | SEQ ID NO: 783 |
| 10-35 | ACE2 H378A | ACE2 H378A | Collectrin-like | SEQ ID NO: 782 | Collectrin | SEQ ID NO: 783 |
| 10-36 | ACE2 E201A | ACE2 E201A | Collectrin-like | SEQ ID NO: 782 | Collectrin | SEQ ID NO: 783 |
| 10-37 | ACE2 wt | ACE2 wt | Collectrin-like | SEQ ID NO: 782 | Collectrin | SEQ ID NO: 786 |
| 10-38 | ACE2 R273A | ACE2 R273A | Collectrin-like | SEQ ID NO: 782 | Collectrin | SEQ ID NO: 786 |
| 10-39 | ACE2 R273G | ACE2 R273G | Collectrin-like | SEQ ID NO: 782 | Collectrin | SEQ ID NO: 786 |
| 10-40 | ACE2 R273V | ACE2 R273V | Collectrin-like | SEQ ID NO: 782 | Collectrin | SEQ ID NO: 786 |
| 10-41 | ACE2 H378A | ACE2 H378A | Collectrin-like | SEQ ID NO: 782 | Collectrin | SEQ ID NO: 786 |
| 10-42 | ACE2 E201A | ACE2 E201A | Collectrin-like | SEQ ID NO: 782 | Collectrin | SEQ ID NO: 786 |
| 10-43 | ACE2 wt | ACE2 wt | Collectrin-like | SEQ ID NO: 782 | Collectrin-like | SEQ ID NO: 782 |
| 10-44 | ACE2 R273A | ACE2 R273A | Collectrin-like | SEQ ID NO: 782 | Collectrin-like | SEQ ID NO: 782 |
| 10-45 | ACE2 R273G | ACE2 R273G | Collectrin-like | SEQ ID NO: 782 | Collectrin-like | SEQ ID NO: 782 |
| 10-46 | ACE2 R273V | ACE2 R273V | Collectrin-like | SEQ ID NO: 782 | Collectrin-like | SEQ ID NO: 782 |
| 10-47 | ACE2 H378A | ACE2 H378A | Collectrin-like | SEQ ID NO: 782 | Collectrin-like | SEQ ID NO: 782 |
| 10-48 | ACE2 E201A | ACE2 E201A | Collectrin-like | SEQ ID NO: 782 | Collectrin-like | SEQ ID NO: 782 |
| 10-49 | ACE2 wt | ACE2 wt | Collectrin-like | SEQ ID NO: 782 | Collectrin-like | SEQ ID NO: 782 |
| 10-50 | ACE2 R273A | ACE2 R273A | Collectrin-like | SEQ ID NO: 782 | Collectrin-like | SEQ ID NO: 782 |
| 10-51 | ACE2 R273G | ACE2 R273G | Collectrin-like | SEQ ID NO: 782 | Collectrin-like | SEQ ID NO: 782 |
| 10-52 | ACE2 R273V | ACE2 R273V | Collectrin-like | SEQ ID NO: 782 | Collectrin-like | SEQ ID NO: 782 |
| 10-53 | ACE2 H378A | ACE2 H378A | Collectrin-like | SEQ ID NO: 782 | Collectrin-like | SEQ ID NO: 782 |
| 10-54 | ACE2 E201A | ACE2 E201A | Collectrin-like | SEQ ID NO: 782 | Collectrin-like | SEQ ID NO: 782 |
| 10-55 | ACE2 wt | ACE2 wt | Collectrin-like | SEQ ID NO: 782 | | |
| 10-56 | ACE2 R273A | ACE2 R273A | Collectrin-like | SEQ ID NO: 782 | | |
| 10-57 | ACE2 R273G | ACE2 R273G | Collectrin-like | SEQ ID NO: 782 | | |
| 10-58 | ACE2 R273V | ACE2 R273V | Collectrin-like | SEQ ID NO: 782 | | |
| 10-59 | ACE2 H378A | ACE2 H378A | Collectrin-like | SEQ ID NO: 782 | | |
| 10-60 | ACE2 E201A | ACE2 E201A | Collectrin-like | SEQ ID NO: 782 | | |
| 10-61 | ACE2 wt | ACE2 wt | Collectrin-like | SEQ ID NO: 782 | | |
| 10-62 | ACE2 R273A | ACE2 R273A | Collectrin-like | SEQ ID NO: 782 | | |
| 10-63 | ACE2 R273G | ACE2 R273G | Collectrin-like | SEQ ID NO: 782 | | |
| 10-64 | ACE2 R273V | ACE2 R273V | Collectrin-like | SEQ ID NO: 782 | | |
| 10-65 | ACE2 H378A | ACE2 H378A | Collectrin-like | SEQ ID NO: 782 | | |
| 10-66 | ACE2 E201A | ACE2 E201A | Collectrin-like | SEQ ID NO: 782 | | |

TABLE 26B

| | | Specific Activity (pmol/min/ug) | | |
|---|---|---|---|---|
| Protein ID | ACE2 | Angiotensin II | Bradykinin | Apelin-13 |
| 13-17 | wt | 1655.2 | 1724.8 | 688 |
| 13-18 | H378A | 0.76 | 1.14 | 1.01 |

Example 11—SARS-CoV-2 Neutralizing Antibodies

Biosimilar versions of eight antibodies that have received Emergency Use Authorization or are in late stage trials, REGN10897, REGN10933, Bamlanivimab, Etesevimab, AZD1061, AZD 8895, VIR-7841, and CT-P59, were produced according to Table 27 to evaluate the relative effectiveness of ACE2 superdimeric tetrahedral antibodies against SARS-CoV-2 variants.

TABLE 27

| Protein ID | Antibody Name | Other Name | Fc Domain Mutations | L Chain | H Chain |
|---|---|---|---|---|---|
| 12-01 | Imdevimab | REGN10987 | | SEQ ID NO: 423 | SEQ ID NO: 424 |
| 12-02 | Casirivimab | REGN10933 | | SEQ ID NO: 429 | SEQ ID NO: 430 |
| 12-03 | Bamlanivimab | LY-CoV555 | | SEQ ID NO: 441 | SEQ ID NO: 442 |
| 12-04 | Etesevimab | LY-CoV016 | L234A/L235A | SEQ ID NO: 445 | SEQ ID NO: 446 |
| 12-05 | Cilgavimab | AZD1061 | L234F/L235E/P331S M252Y/S254T/T256E | SEQ ID NO: 449 | SEQ ID NO: 450 |
| 12-06 | Tixagevimab | AZD8895 | L234F/L235E/P331S M252Y/S254T/T256E | SEQ ID NO: 453 | SEQ ID NO: 454 |
| 12-07 | Sotrovimab | VIR-7831 | M428L/N434S | SEQ ID NO: 457 | SEQ ID NO: 458 |
| 12-08 | Regdanvimab | CT-P59 | | SEQ ID NO: 461 | SEQ ID NO: 462 |
| 12-09 | B13A-PG | | L234A/L235A/P329G | SEQ ID NO: 465 | SEQ ID NO: 466 |
| 12-10 | O24A-PG | | L234A/L235A/P329G | SEQ ID NO: 469 | SEQ ID NO: 470 |

TABLE 27-continued

| Protein ID | Antibody Name | Other Name | Fc Domain Mutations | L Chain | H Chain |
|---|---|---|---|---|---|
| 16-01 | B13A | | | SEQ ID NO: 465 | SEQ ID NO: 554 |
| 16-02 | O24A | | | SEQ ID NO: 469 | SEQ ID NO: 555 |

Example 12

Figure 32:
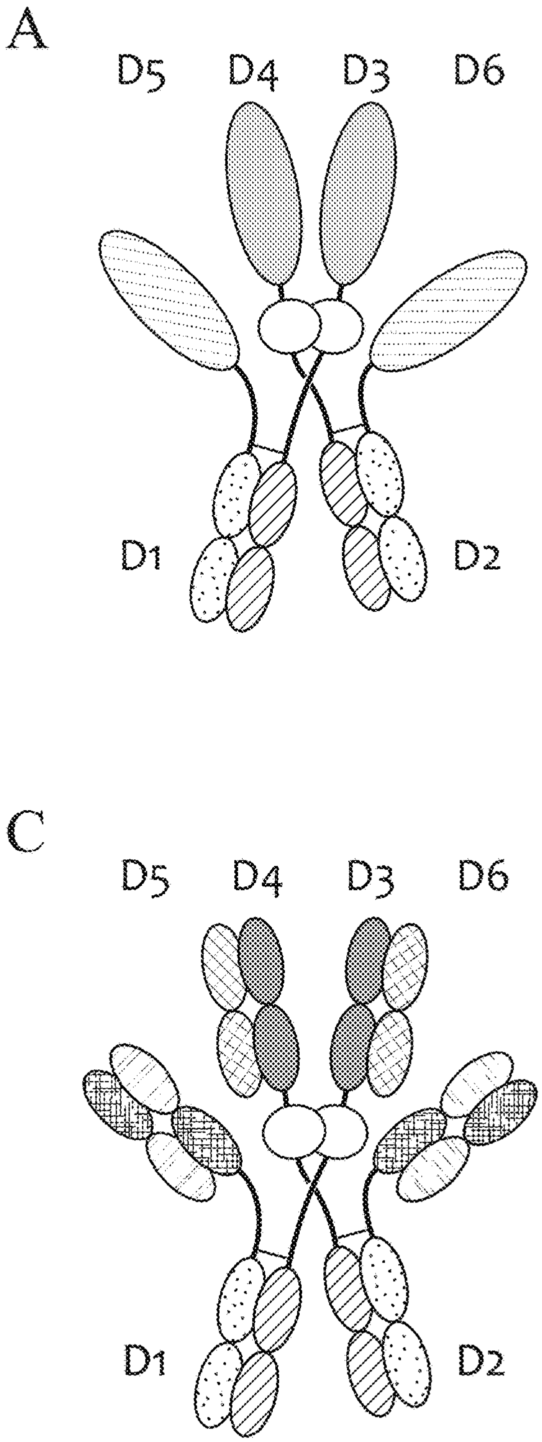
FIG. 32: Tetrahedral antibody comprising a first and second dimerizing polypeptide that form a homodimeric non-covalent linkage, wherein each of D1 and D2 is a heterodimeric Fc domain, and wherein (A) D3 and D4 specifically bind to a first target, and D5 and D6 specifically bind to a second target (tetravalent, 2+2 bispecific), (B) D5 and D6 specifically bind to a first target, and D3 and D4 specifically bind to a second target (tetravalent, 2+2 bispecific), (C) D3 and D4 are Fab domains that specifically bind to a first target, and D5 and D6 are variable region exchanged Fab domains that specifically bind to a second target (tetravalent, 2+2 bispecific), and (D) D5 and D6 are Fab domains that specifically bind to a first target, and D3 and D4 are variable region exchanged Fab domains that specifically bind to a second target (tetravalent, 2+2 bispecific). The tetrahedral antibodies of A-D comprise (A) four chains: a first H1 chain [D1/D3], a second H1 chain [D2/D4], a first H2 chain [D1/D5], and a second H2 chain [D2/D6], (B) four chains: a first H1 chain [D1/D3], a second H1 chain [D2/D4], a first H2 chain [D1/D5], and a second H2 chain [D2/D6], (C) eight chains: a first H1 chain [D1/D3], a second H1 chain [D2/D4], a first H2 chain [D1/D5], a second H2 chain [D2/D6], a first L1 chain [D3], a second L1 chain [D4], a first L2 chain [D5], and a second L2 chain [D6], and (D) eight chains: a first H1 chain [D1/D3], a second H1 chain [D2/D4], a first H2 chain [D1/D5], a second H2 chain [D2/D6], a first L1 chain [D3], a second L1 chain [D4], a first L2 chain [D5], and a second L2 chain [D6].
Figure 33:
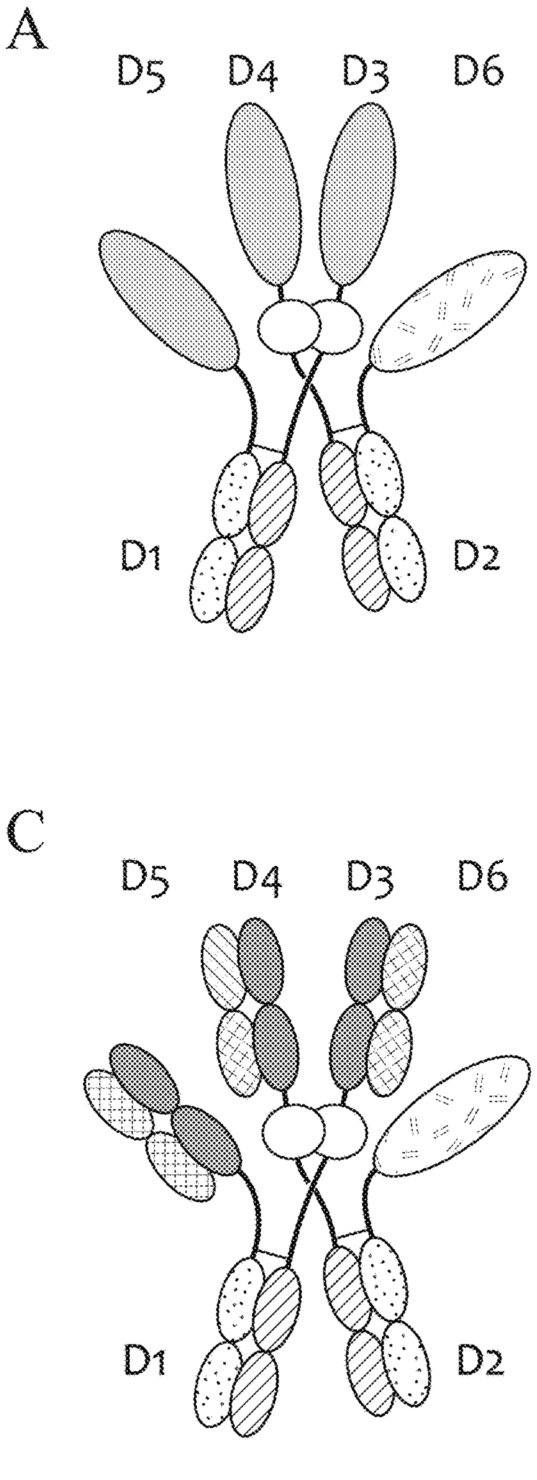
FIG. 33: Tetrahedral antibody comprising a first and second dimerizing polypeptide that form a homodimeric non-covalent linkage, wherein each of D1 and D2 is a heterodimeric Fc domain, and wherein (A) D3, D4 and D5 specifically bind to a first target, and D6 specifically binds to a second target (tetravalent, 3+1 bispecific), (B) D3, D4 and D5 specifically bind to a first target, and D6 is a Fab domain that specifically binds to a second target (tetravalent, 3+1 bispecific), (C) D3, D4 and D5 are Fab domains that specifically bind to a first target, and D6 specifically binds to a second target (tetravalent, 3+1 bispecific), and (D) D3, D4 and D5 are Fab domains that specifically bind to a first target, and D6 is a variable region exchanged Fab domain that specifically binds to a second target (tetravalent, 3+1 bispecific). The tetrahedral antibodies of A-D comprise (A) four chains: a first H1 chain [D1/D3], a second H1 chain [D2/D4], a first H2 chain [D1/D5], and a first H3 chain [D2/D6], (B) five chains: a first H1 chain [D1/D3], a second H1 chain [D2/D4], a first H2 chain [D1/D5], a first H3 chain [D2/D6], and a first L3 chain [D6], (C) seven chains: a first H1 chain [D1/D3], a second H1 chain [D2/D4], a first H2 chain [D1/D5], a first H3 chain [D2/D6], a first L1/L2 chain [D3], a second L1/L2 chain [D4], and a third L1/L2 chain [D5], and (D) eight chains: a first H1 chain [D1/D3], a second H1 chain [D2/D4], a first H2 chain [D1/D5], a first H3 chain [D2/D6], a first L1/L2 chain [D3], a second L1/L2 chain [D4], a third L1/L2 chain [D5], and a first L3 chain [D6].
Figure 34:
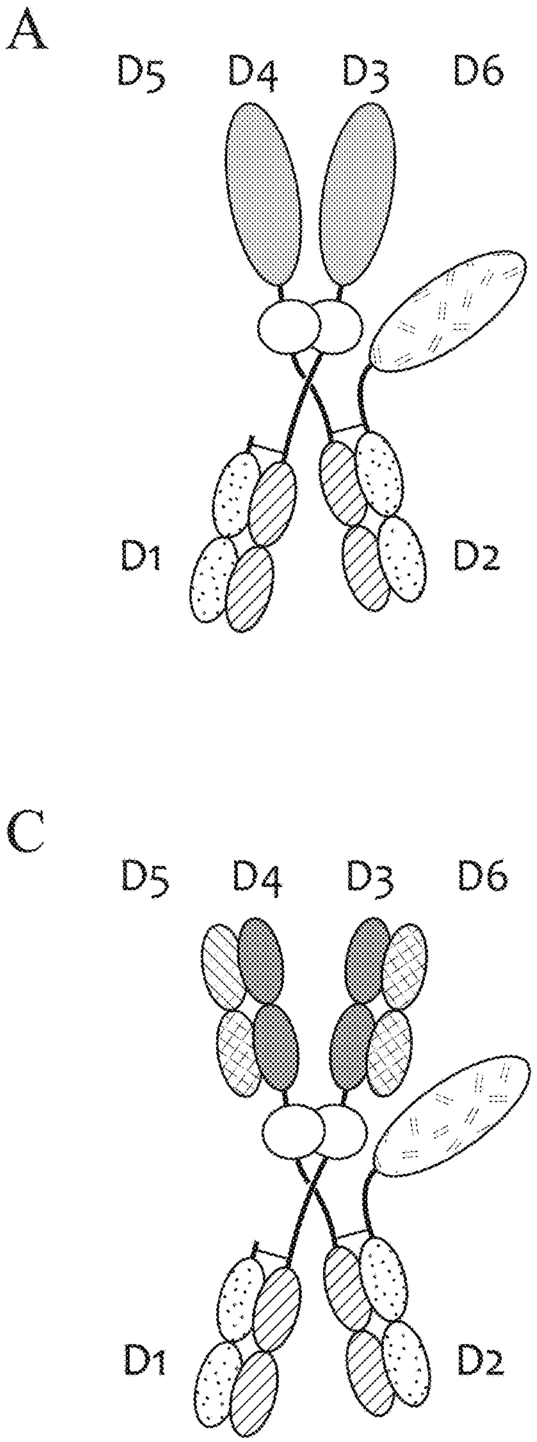
FIG. 34: Tetrahedral antibody comprising a first and second dimerizing polypeptide that form a homodimeric non-covalent linkage, wherein each of D1 and D2 is a heterodimeric Fc domain, and wherein (A) D3 and D4 specifically bind to a first target, and D6 specifically binds to a second target (trivalent, 2+1 bispecific), (B) D3 and D4 specifically bind to a first target, and D6 is a Fab domain that specifically binds to a second target (trivalent, 2+1 bispecific), (C) D3 and D4 are Fab domains that specifically bind to a first target, and D6 specifically binds to a second target (trivalent, 2+1 bispecific), and (D) D3 and D4 are Fab domains that specifically bind to a first target, and D6 is a variable region exchanged Fab domain that specifically binds to a second target (trivalent, 2+1 bispecific). The tetrahedral antibodies of A-D comprise (A) four chains: a first H1 chain [D1/D3], a second H1 chain [D2/D4], a first H2 chain [D2/D6], and a first Fc chain [D1], (B) five chains: a first H1 chain [D1/D3], a second H1 chain [D2/D4], a first H2 chain [D2/D6], a first Fc chain [D1], and a first L2 chain [D6], (C) six chains: a first H1 chain [D1/D3], a second H1 chain [D2/D4], a first H2 chain [D2/D6], a first Fc chain [D1], a first L1 chain [D3], and a second L1 chain [D4], and (D) seven chains: a first H1 chain [D1/D3], a second H1 chain [D2/D4], a first H2 chain [D2/D6], a first Fc chain [D1], a first L1 chain [D3], a second L1 chain [D4], and a first L2 chain [D6].
Figure 35:
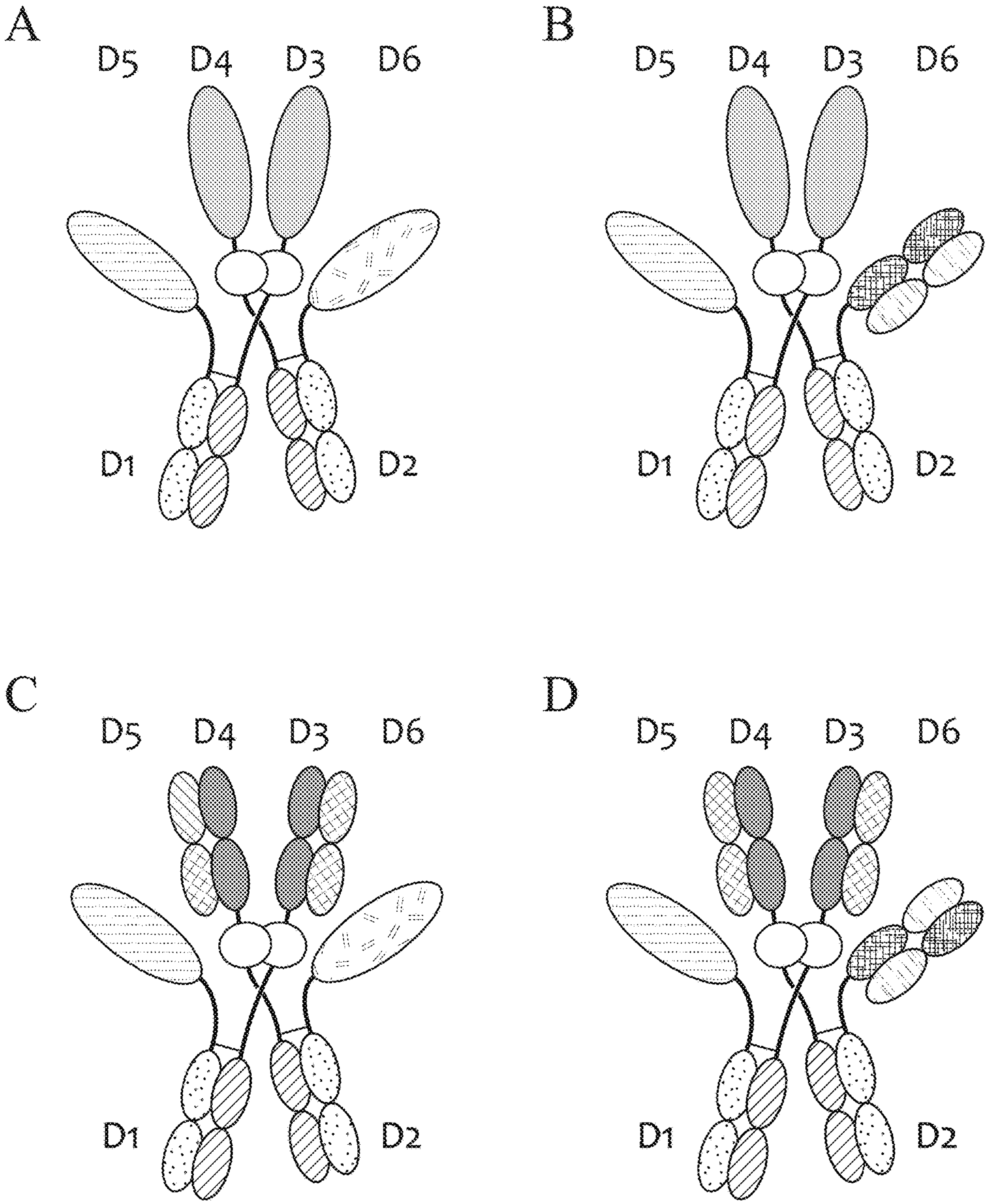
FIG. 35: Tetrahedral antibody comprising a first and second dimerizing polypeptide that form a homodimeric non-covalent linkage, wherein each of D1 and D2 is a heterodimeric Fc domain, and wherein (A) D3 and D4 specifically bind to a first target, D5 specifically binds to a second target, and D6 specifically binds to a third target (tetravalent, 2+1+1 trispecific), (B) D3 and D4 specifically bind to a first target, D5 specifically binds to a second target, and D6 is a Fab domain that specifically binds to a third target (tetravalent, 2+1+1 trispecific), (C) D3 and D4 are Fab domains that specifically bind to a first target, D5 specifically binds to a second target, and D6 specifically binds to a third target (tetravalent, 2+1+1 trispecific), and (D) D3 and D4 are Fab domains that specifically bind to a first target, D5 specifically binds to a second target, and D6 is a variable region exchanged Fab domain that specifically binds to a third target (tetravalent, 2+1+1 trispecific). The tetrahedral antibodies of A-D comprise (A) four chains: a first H1 chain [D1/D3], a second H1 chain [D2/D4], a first H2 chain [D1/D5], and a first H3 chain [D2/D6], (B) five chains: a first H1 chain [D1/D3], a second H1 chain [D2/D4], a first H2 chain [D1/D5], a first H3 chain [D2/D6], and a first L3 chain [D6], (C) six chains: a first H1 chain [D1/D3], a second H1 chain [D2/D4], a first H2 chain [D1/D5], a first H3 chain [D2/D6], a first L1 chain [D3], and a second L1 chain [D4], and (D) seven chains: a first H1 chain [D1/D3], a second H1 chain [D2/D4], a first H2 chain [D1/D5], a first H3 chain [D2/D6], a first L1 chain [D3], a second L1 chain [D4], and a first L3 chain [D6].
Figure 36:
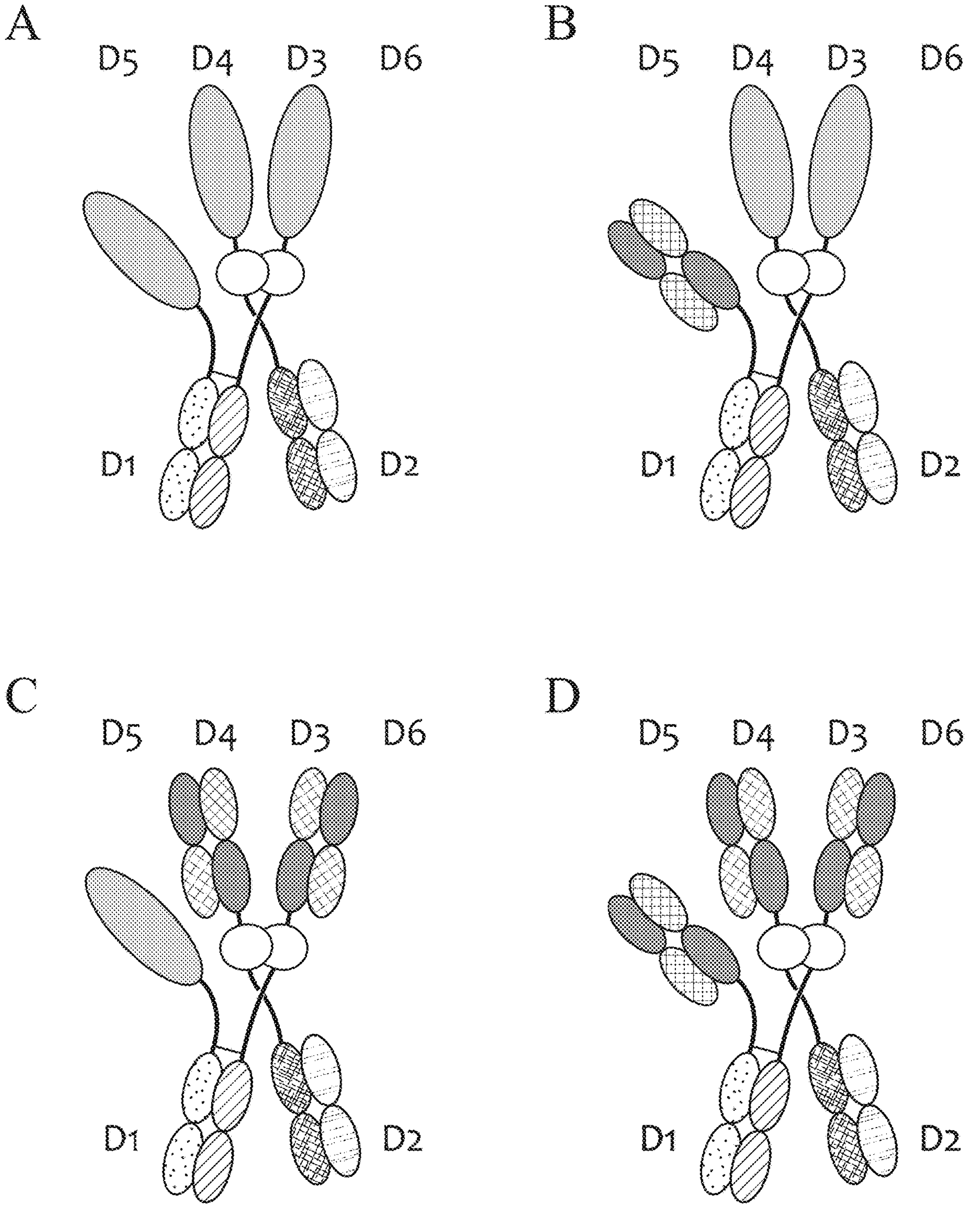
FIG. 36: Tetrahedral antibody comprising a first and second dimerizing polypeptide that form a homodimeric non-covalent linkage, wherein D1 is a heterodimeric Fc domain and D2 is a Fab domain, and wherein (A) D2 is a Fab that binds to a first target, and D3, D4 and D5 specifically bind to a second target (tetravalent, 3+1 bispecific), (B) D2 is a Fab that binds to a first target, D3 and D4 specifically bind to a second target, and D5 is a variable region exchanged Fab that specifically bind to a third target (tetravalent, 2+1+1 trispecific), (C) D2 is a Fab that binds to a first target, D3 and D4 are variable region exchanged Fab domains that specifically bind to a second target, and D5 specifically binds to a third target (tetravalent, 2+1+1 trispecific), and (D) D2 is a Fab that binds to a first target, D3, D4 and D5 are variable region exchanged Fab domains that specifically bind to a second target (tetravalent, 4+1 bispecific). The tetrahedral antibodies of A-D comprise (A) four chains: a first H1 chain [D1/D3], a first H1Fab chain [D2/D4], a first H2 chain [D1/D5], and a first Fab chain [D2], (B) five chains: a first H1 chain [D1/D3], a first H1Fab chain [D2/D4], a first H2 chain [D1/D5], a first Fab chain [D2], and a first L2 chain [D5], (C) six chains: a first H1 chain [D1/D3], a first H1Fab chain [D2/D4], a first H2 chain [D1/D5], a first Fab chain [D2], a first L1 chain [D3], and a second L1 chain [D4], (D) seven chains: a first H1 chain [D1/D3], a first H1Fab chain [D2/D4], a first H2 chain [D1/D5], a first Fab chain [D2], a first L1/L2 chain [D3], a second L1/L2 chain [D4], and a third L1/L2 chain [D5].

To provide proof-of-principle demonstrating tetrahedral antibodies comprising two distinct types of domain that specifically bind two different targets, two series of constructs were generated, a first series with the predicted structure shown in Panel B of FIG. 31, according to Tables 28 and 29, and a second series with the predicted structure shown in Panel C of FIG. 32, according to Tables 30 and 31, then evaluated for their structural and functional bispecificity.

TABLE 28

| Protein ID | Protein Name | H1 Chain | L2 Chain | H2 Chain |
|---|---|---|---|---|
| 13-01 | ACE2FcPG-740wt201RF/REGN10987 | SEQ ID NO: 471 | SEQ ID NO: 423 | SEQ ID NO: 472 |
| 13-02 | ACE2FcPG-740HA201RF/REGN10987 | SEQ ID NO: 473 | SEQ ID NO: 423 | SEQ ID NO: 472 |
| 13-03 | ACE2FcPG-740wt201RF/REGN10933 | SEQ ID NO: 471 | SEQ ID NO: 429 | SEQ ID NO: 474 |
| 13-04 | ACE2FcPG-740HA201RF/REGN10933 | SEQ ID NO: 473 | SEQ ID NO: 429 | SEQ ID NO: 474 |
| 13-05 | ACE2FcPG-740wt201RF/Bamlanivimab | SEQ ID NO: 471 | SEQ ID NO: 441 | SEQ ID NO: 475 |
| 13-06 | ACE2FcPG-740HA201RF/Bamlanivimab | SEQ ID NO: 473 | SEQ ID NO: 441 | SEQ ID NO: 475 |
| 13-07 | ACE2FcPG-740wt201RF/Etesevimab | SEQ ID NO: 471 | SEQ ID NO: 445 | SEQ ID NO: 476 |
| 13-08 | ACE2FcPG-740HA201RF/Etesevimab | SEQ ID NO: 473 | SEQ ID NO: 445 | SEQ ID NO: 476 |
| 13-09 | ACE2FcFES-740wt201RF/Cilgavimab-YTE | SEQ ID NO: 477 | SEQ ID NO: 449 | SEQ ID NO: 478 |
| 13-10 | ACE2FcFES-740HA201RF/Cilgavimab-YTE | SEQ ID NO: 479 | SEQ ID NO: 449 | SEQ ID NO: 478 |
| 13-11 | ACE2FcFES-740wt201RF/Tixagevimab-YTE | SEQ ID NO: 477 | SEQ ID NO: 453 | SEQ ID NO: 480 |
| 13-12 | ACE2FcFES-740HA201RF/Tixagevimab-YTE | SEQ ID NO: 479 | SEQ ID NO: 453 | SEQ ID NO: 480 |
| 13-13 | ACE2FcPG-740wt201RF/Sotrovimab | SEQ ID NO: 481 | SEQ ID NO: 457 | SEQ ID NO: 482 |
| 13-14 | ACE2FcPG-740HA201RF/Sotrovimab | SEQ ID NO: 483 | SEQ ID NO: 457 | SEQ ID NO: 482 |
| 13-15 | ACE2FcPG-740wt201RF/Regdanvimab | SEQ ID NO: 471 | SEQ ID NO: 461 | SEQ ID NO: 484 |
| 13-16 | ACE2FcPG-740HA201RF/Regdanvimab | SEQ ID NO: 473 | SEQ ID NO: 461 | SEQ ID NO: 484 |
| 13-17 | ACE2FcPG-740wt201RF/B13A | SEQ ID NO: 471 | SEQ ID NO: 465 | SEQ ID NO: 485 |
| 13-18 | ACE2FcPG-740HA201RF/B13A | SEQ ID NO: 473 | SEQ ID NO: 465 | SEQ ID NO: 485 |
| 13-19 | ACE2FcPG-740wt201RF/024A | SEQ ID NO: 471 | SEQ ID NO: 469 | SEQ ID NO: 486 |
| 13-20 | ACE2FcPG-740HA201RF/024A | SEQ ID NO: 473 | SEQ ID NO: 469 | SEQ ID NO: 486 |
| 13-21 | ACE2FcFES-740wt201RF/B13A-YTE | SEQ ID NO: 477 | SEQ ID NO: 465 | SEQ ID NO: 487 |
| 13-22 | ACE2FcFES-740HA201RF/B13A-YTE | SEQ ID NO: 479 | SEQ ID NO: 465 | SEQ ID NO: 487 |
| 13-23 | ACE2FcFES-740wt201RF/O24A-YTE | SEQ ID NO: 477 | SEQ ID NO: 469 | SEQ ID NO: 488 |
| 13-24 | ACE2FcFES-740HA201RF/O24A-YTE | SEQ ID NO: 479 | SEQ ID NO: 469 | SEQ ID NO: 488 |

TABLE 29

| Protein ID | Domain Type D3/D4 | Domain Type D5/D6 | First Dimerizing Polypeptide Pair D3/D4 | First Dimerizing Polypeptide Sequence | Fc Domain Type D1/D2 |
|---|---|---|---|---|---|
| 13-01 | ACE2 wt | REGN10987 | Collectrin-like | SEQ ID NO: 782 | L234A/L235A/P329G |
| 13-02 | ACE2 H378A | REGN10987 | Collectrin-like | SEQ ID NO: 782 | L234A/L235A/P329G |
| 13-03 | ACE2 wt | REGN10933 | Collectrin-like | SEQ ID NO: 782 | L234A/L235A/P329G |
| 13-04 | ACE2 H378A | REGN10933 | Collectrin-like | SEQ ID NO: 782 | L234A/L235A/P329G |
| 13-05 | ACE2 wt | LY-CoV555 | Collectrin-like | SEQ ID NO: 782 | L234A/L235A/P329G |
| 13-06 | ACE2 H378A | LY-CoV555 | Collectrin-like | SEQ ID NO: 782 | L234A/L235A/P329G |
| 13-07 | ACE2 wt | LY-CoV016 | Collectrin-like | SEQ ID NO: 782 | L234A/L235A/P329G |
| 13-08 | ACE2 H378A | LY-CoV016 | Collectrin-like | SEQ ID NO: 782 | L234A/L235A/P329G |
| 13-09 | ACE2 wt | AZD1061 | Collectrin-like | SEQ ID NO: 782 | L234F/L235E/P331S<br>M252Y/S254T/T256E |
| 13-10 | ACE2 H378A | AZD1061 | Collectrin-like | SEQ ID NO: 782 | L234F/L235E/P331S<br>M252Y/S254T/T256E |
| 13-11 | ACE2 wt | AZD8895 | Collectrin-like | SEQ ID NO: 782 | L234F/L235E/P331S<br>M252Y/S254T/T256E |
| 13-12 | ACE2 H378A | AZD8895 | Collectrin-like | SEQ ID NO: 782 | L234F/L235E/P331S<br>M252Y/S254T/T256E |
| 13-13 | ACE2 wt | VIR-7831 | Collectrin-like | SEQ ID NO: 782 | L234A/L235A/P329G<br>M428L/N434S |

TABLE 29-continued

| Protein ID | Domain Type D3/D4 | Domain Type D5/D6 | First Dimerizing Polypeptide Pair D3/D4 | First Dimerizing Polypeptide Sequence | Fc Domain Type D1/D2 |
|---|---|---|---|---|---|
| 13-14 | ACE2 H378A | VIR-7831 | Collectrin-like | SEQ ID NO: 782 | L234A/L235A/P329G M428L/N434S |
| 13-15 | ACE2 wt | CT-P59 | Collectrin-like | SEQ ID NO: 782 | L234A/L235A/P329G |
| 13-16 | ACE2 H378A | CT-P59 | Collectrin-like | SEQ ID NO: 782 | L234A/L235A/P329G |
| 13-17 | ACE2 wt | B13A | Collectrin-like | SEQ ID NO: 782 | L234A/L235A/P329G |
| 13-18 | ACE2 H378A | B13A | Collectrin-like | SEQ ID NO: 782 | L234A/L235A/P329G |
| 13-19 | ACE2 wt | O24A | Collectrin-like | SEQ ID NO: 782 | L234A/L235A/P329G |
| 13-20 | ACE2 H378A | O24A | Collectrin-like | SEQ ID NO: 782 | L234A/L235A/P329G |
| 13-21 | ACE2 wt | B13A | Collectrin-like | SEQ ID NO: 782 | L234F/L235E/P331S M252Y/S254T/T256E |
| 13-22 | ACE2 H378A | B13A | Collectrin-like | SEQ ID NO: 782 | L234F/L235E/P331S M252Y/S254T/T256E |
| 13-23 | ACE2 wt | O24A | Collectrin-like | SEQ ID NO: 782 | L234F/L235E/P331S M252Y/S254T/T256E |
| 13-24 | ACE2 H378A | O24A | Collectrin-like | SEQ ID NO: 782 | L234F/L235E/P331S M252Y/S254T/T256E |

Example 13

TABLE 30

| Protein ID | Protein Name | L1 Chain | H1 Chain | L2 Chain | H2 Chain |
|---|---|---|---|---|---|
| 14-01 | REGN10987-CLD201RF-N84S/REGN10987 | SEQ ID NO: 423 | SEQ ID NO: 489 | SEQ ID NO: 423 | SEQ ID NO: 472 |
| 14-02 | REGN10987(x)CLD201RF-N84S/REGN10933 | SEQ ID NO: 503 | SEQ ID NO: 490 | SEQ ID NO: 429 | SEQ ID NO: 474 |
| 14-03 | REGN10933-CLD201RF-N84S/REGN10933 | SEQ ID NO: 429 | SEQ ID NO: 491 | SEQ ID NO: 429 | SEQ ID NO: 474 |
| 14-04 | REGN10933(x)CLD201RF-N84S/REGN10987 | SEQ ID NO: 504 | SEQ ID NO: 492 | SEQ ID NO: 423 | SEQ ID NO: 472 |
| 14-05 | Bamlanivimab-CLD201RF/Bamlanivimab | SEQ ID NO: 441 | SEQ ID NO: 493 | SEQ ID NO: 441 | SEQ ID NO: 475 |
| 14-06 | Bamlanivimab(x)CLD201RF/Etesevimab | SEQ ID NO: 505 | SEQ ID NO: 494 | SEQ ID NO: 445 | SEQ ID NO: 476 |
| 14-07 | Etesevimab-CLD201RF-N83S/Etesevimab | SEQ ID NO: 445 | SEQ ID NO: 495 | SEQ ID NO: 445 | SEQ ID NO: 476 |
| 14-08 | Etesevimab(x)CLD201RF-N83S/Bamlanivimab | SEQ ID NO: 506 | SEQ ID NO: 496 | SEQ ID NO: 441 | SEQ ID NO: 475 |
| 14-09 | Cilgavimab-CLD201RF-N86S/Cilgavimab-YTE | SEQ ID NO: 449 | SEQ ID NO: 497 | SEQ ID NO: 449 | SEQ ID NO: 478 |
| 14-10 | Cilgavimab(x)CLD201RF-N86S/Tixagevimab-YTE | SEQ ID NO: 507 | SEQ ID NO: 498 | SEQ ID NO: 453 | SEQ ID NO: 480 |
| 14-11 | Tixagevimab-CLD201RF/Tixagevimab | SEQ ID NO: 453 | SEQ ID NO: 499 | SEQ ID NO: 453 | SEQ ID NO: 480 |
| 14-12 | Tixagevimab(x)CLD201RF/Cilgavimab | SEQ ID NO: 508 | SEQ ID NO: 500 | SEQ ID NO: 449 | SEQ ID NO: 478 |
| 14-13 | Sotrovimab-CLD201RF/Sotrovimab | SEQ ID NO: 457 | SEQ ID NO: 501 | SEQ ID NO: 457 | SEQ ID NO: 482 |
| 14-14 | Regdanvimab-CLD201RF/Regdanvimab | SEQ ID NO: 461 | SEQ ID NO: 502 | SEQ ID NO: 461 | SEQ ID NO: 484 |

TABLE 31

| Protein ID | Domain Type D3/D4 | Fab Domain Configuration D3/D4 | Domain Type D5/D6 | Fab Domain Configuration D5/D6 | Fc Domain Type D1/D2 |
|---|---|---|---|---|---|
| 14-01 | REGN10987 | VL-CL/VH-CH1 | REGN10987 | VL-CL/VH-CH1 | L234A/L235A/P329G |
| 14-02 | REGN10987 | VH-CHl/VL-CL | REGN10933 | VK-CK/VH-CH1 | L234A/L235A/P329G |
| 14-03 | REGN10933 | VK-CK/VH-CH1 | REGN10933 | VK-CK/VH-CH1 | L234A/L235A/P329G |
| 14-04 | REGN10933 | VH-CH1/VK-CK | REGN10987 | VL-CL/VH-CH1 | L234A/L235A/P329G |
| 14-05 | LY-CoV555 | VK-CK/VH-CH1 | LY-CoV555 | VK-CK/VH-CH1 | L234A/L235A/P329G |
| 14-06 | LY-CoV555 | VH-CH1/VK-CK | LY-CoV016 | VK-CK/VH-CH1 | L234A/L235A/P329G |
| 14-07 | LY-CoV016 | VK-CK/VH-CH1 | LY-CoV016 | VK-CK/VH-CH1 | L234A/L235A/P329G |
| 14-08 | LY-CoV016 | VH-CH1/VK-CK | LY-CoV555 | VK-CK/VH-CH1 | L234A/L235A/P329G |
| 14-09 | AZD1061 | VK-CK/VH-CH1 | AZD1061 | VK-CK/VH-CH1 | L234F/L235E/P331S M252Y/S254T/T256E |
| 14-10 | AZD1061 | VH-CH1/VK-CK | AZD8895 | VK-CK/VH-CH1 | L234F/L235E/P331S M252Y/S254T/T256E |
| 14-11 | AZD8895 | VK-CK/VH-CH1 | AZD8895 | VK-CK/VH-CH1 | L234F/L235E/P331S M252Y/S254T/T256E |
| 14-12 | AZD8895 | VH-CH1/VK-CK | AZD1061 | VK-CK/VH-CH1 | L234F/L235E/P331S M252Y/S254T/T256E |
| 14-13 | VIR-7831 | VK-CK/VH-CH1 | VIR-7831 | VK-CK/VH-CH1 | L234A/L235A/P329G M428L/N434S |
| 14-14 | CT-P59 | VL-CL/VH-CH1 | CT-P59 | VL-CL/VH-CH1 | L234A/L235A/P329G |

Example 14—Pharmacokinetics

Pharmacokinetic studies were carried out with two series of constructs designed to evaluate the effect of mutations in the Fc region that affect FcgR and FcRn binding. The first series is described in Tables 28 and 29, The second series is described in Tables 33 and 34.

Methods: The study was conducted by The Jackson Laboratory, Bar Harbor, ME. 6-8 week old male B6.Cg-Fcgrttm1Dcr Tg (FCGRT) 32Dcr/DcrJ mice were homozygous for the human FcRn transgene. Body weights were measured within 1 day of each test article administration. At 0 hours on Day 0, COVICEPT was administered by IV injection at 10 mg/kg in a volume of 5 ml/kg. 25 μL blood samples were collected from each mouse at 5 m, 6 h, 1 d, 4 d, 7 d, 10 d, 14 d, 17 d, 21 d, and 28 d. The blood samples were collected into 1 uL of $K_3EDTA$, processed to plasma, diluted 1/10 in 50% glycerol in PBS, frozen in specialized 96 well storage pates and stored at −20° C. Plasma samples were assessed by electrochemiluminescent immunoassay (Meso Scale Diagnostics LLC, Rockville, MD) to detect the level of COVICEPT.

Electrochemiluminescent immunoassay: Wild-type spike protein (LakePharma, Inc., San Carlos, CA) was diluted to 20 nM with PBS and coated on QuickPlex 96-Well plates (Meso Scale Diagnostics) with 25 μL per well. The plates were sealed and incubated overnight at 4° C. The plates were then blocked by PBS-B (PBS with 1% BSA) at room temperature for 30 minutes. The plasma samples were diluted 250- to 4000-fold with PBS-B. Twenty five microliters of the diluted plasma samples were added to the coated MSD plates using Biomek 15 liquid handler (Beckman Coulter Inc., Brea, CA). Plasma samples were incubated with shaking (700 rpm) at room temperature for 60 mins. Twenty five microliters of biotinylated goat anti human-Fab antibody (Abcam), or biotinylated goat Anti-Human ACE-2 detection antibody (R&D Systems) was used as a detection antibody. Detection antibody was incubated with shaking (700 rpm) at room temperature for 60 mins. Twenty five microliters of sulfo-tag streptavidin and Read buffer A (Meso Scale Diagnostics LLC, Rockville, MD) were then added to generate the electrochemiluminescent signal. Data were analyzed with MSD discovery workbench 4.0.13 (Meso Scale Diagnostics LLC, Rockville, MD). Pharmacokinetic analysis was performed using PKSolver22.

TABLE 32A

| Protein ID | Protein Name | Detection | Half-life (days) |
|---|---|---|---|
| 1317 | B13-ACE2 WT | ACE2 | 4.6 |
| | | Fab | 4.9 |
| 1318 | B13-ACE2HA | ACE2 | 5.4 |
| | | Fab | 5.4 |
| 1321 | B13-ACE2 WT_YTE | ACE2 | 9.0 |
| | | Fab | 9.4 |
| 1322 | B13-ACE2 HA_YTE | ACE2 | 7.9 |
| | | Fab | 8.3 |

TABLE 32C

| Protein ID | Domain Type D3/D4 | Domain Type D5/D6 | FcR Domain Type D1/D2 | FcRn Domain Type D1/D2 | Half-life (days) |
|---|---|---|---|---|---|
| 15-01 | ACE2 H378A | ACE2 H378A | L234A/L235A/P329G | | 1.3 |
| 15-02 | ACE2 H378A | ACE2 H378A | L234A/L235A/P329G | | 1.1 |
| 15-03 | ACE2 H378A | ACE2 H378A | L234A/L235A/P329G | M252Y/S254T/T256E | 1.7 |
| 15-04 | ACE2 H378A | ACE2 H378A | L234A/L235A/P329G | M252Y/S254T/T256E | 1.1 |
| 15-05 | ACE2 H378A | ACE2 H378A | L234A/L235A/P329G | M428L/N434S | 1.4 |
| 15-06 | ACE2 H378A | ACE2 H378A | L234A/L235A/P329G | M428L/N434S | 1.4 |
| 15-07 | ACE2 H378A | ACE2 H378A | L234A/L235A/P329G | FCΓL309D/Q311H/N434S | 1.1 |
| 15-08 | ACE2 H378A | ACE2 H378A | L234A/L235A/P329G | FCΓL309D/Q311H/N434S | 1.3 |
| 15-09 | ACE2 H378A | B13A | | | 2.8 |
| 15-10 | ACE2 H378A | B13A | L234A/L235A/P329G | | 3.5 |
| 15-11 | ACE2 H378A | B13A | | M252Y/S254T/T256E | 6.2 |
| 15-12 | ACE2 H378A | B13A | L234A/L235A/P329G | M252Y/S254T/T256E | 3.9 |
| 15-13 | ACE2 H378A | B13A | | M428L/N434S | 2.8 |
| 15-14 | ACE2 H378A | B13A | L234A/L235A/P329G | M428L/N434S | 4.5 |
| 15-15 | ACE2 H378A | B13A | | FCΓL309D/Q311H/N434S | 4.4 |
| 15-16 | ACE2 H378A | B13A | L234A/L235A/P329G | FCΓL309D/Q311H/N434S | 6.0 |

Example 15

A series of constructs were generated according to Tables 33 and 34 to evaluate the effect of mutations in the Fc region that affect FcgR and FcRn binding and pharmacokinetics.

The results of the binding measurements are presented in Tables 35A, 35B, 35C, 35D.

Methods: Surface plasmon resonance capture kinetic experiments were performed on a Carterra LSA instrument purchased from Carterra, Inc. Salt Lake City, UT. COVICEPT and its controls (5 μg/ml) were immobilized on the Carterra CMD-P chip using amine coupling. Recombinant Fc gamma receptors (R&D Systems) were diluted with running buffer (PBS with 0.05% TWEEN) to a concentration of 2000 nM, followed by 7 times 3-fold serial dilution to 0.9 nM. Fc gamma receptors were injected onto the CMD-P chip for 5 minutes during the association phase followed by running buffer injection for another 5 minutes during the dissociation phase. The CMD-P chip was regenerated by flowing Pierce™ IgG Elution Buffer for 1 minute (Thermo Fisher Scientific Inc., Waltham, MA) after each round of Fc-gamma receptors injection. Data were analyzed using the Carterra's Kinetic tool.

TABLE 33

| Protein ID | Protein Name | H1 Chain | L2 Chain | H2 Chain |
|---|---|---|---|---|
| 15-01 | ACE2FcPG-740HA201/615HA201RF | SEQ ID NO: 509 | | SEQ ID NO: 510 |
| 15-02 | ACE2FcPG-740HA201RF/615HA201 | SEQ ID NO: 473 | | SEQ ID NO: 511 |
| 15-03 | ACE2FcPG-740HA201/615HA201R F-YTE | SEQ ID NO: 512 | | SEQ ID NO: 513 |
| 15-04 | ACE2FcPG-740HA201RF/615HA201-YTE | SEQ ID NO: 514 | | SEQ ID NO: 515 |
| 15-05 | ACE2FcPG-740HA201/615HA201RF-LS | SEQ ID NO: 516 | | SEQ ID NO: 517 |
| 15-06 | ACE2FcPG-740HA201RF/615HA201-LS | SEQ ID NO: 518 | | SEQ ID NO: 519 |
| 15-07 | ACE2FcPG-740HA201/615HA201RF-DHS | SEQ ID NO: 520 | | SEQ ID NO: 521 |
| 15-08 | ACE2FcPG-740HA201RF/615HA201-DHS | SEQ ID NO: 522 | | SEQ ID NO: 523 |
| 15-09 | ACE2Fc-740HA201RF/B13A | SEQ ID NO: 524 | SEQ ID NO: 465 | SEQ ID NO: 525 |
| 15-10 | ACE2FcPG-740HA201RF/B13A | SEQ ID NO: 473 | SEQ ID NO: 465 | SEQ ID NO: 485 |
| 15-11 | ACE2Fc-740HA201RF/B13A-YTE | SEQ ID NO: 526 | SEQ ID NO: 465 | SEQ ID NO: 527 |
| 15-12 | ACE2FcPG-740HA201RF/B13A-YTE | SEQ ID NO: 514 | SEQ ID NO: 465 | SEQ ID NO: 528 |
| 15-13 | ACE2Fc-740HA201RF/B13A-LS | SEQ ID NO: 529 | SEQ ID NO: 465 | SEQ ID NO: 530 |
| 15-14 | ACE2FcPG-740HA201RF/B13A-LS | SEQ ID NO: 518 | SEQ ID NO: 465 | SEQ ID NO: 531 |
| 15-15 | ACE2Fc-740HA201RF/B13A-DHS | SEQ ID NO: 532 | SEQ ID NO: 465 | SEQ ID NO: 533 |
| 15-16 | ACE2FcPG-740HA201RF/B13A-DHS | SEQ ID NO: 522 | SEQ ID NO: 465 | SEQ ID NO: 534 |
| 15-17 | ACE2Fc-740HA201RF/O24A | SEQ ID NO: 524 | SEQ ID NO: 469 | SEQ ID NO: 535 |
| 15-18 | ACE2FcPG-740HA201RF/O24A | SEQ ID NO: 473 | SEQ ID NO: 469 | SEQ ID NO: 486 |
| 15-19 | ACE2Fc-740HA201RF/O24A-YTE | SEQ ID NO: 526 | SEQ ID NO: 469 | SEQ ID NO: 536 |
| 15-20 | ACE2FcPG-740HA201RF/O24A-YTE | SEQ ID NO: 514 | SEQ ID NO: 469 | SEQ ID NO: 537 |
| 15-21 | ACE2Fc-740HA201RF/O24A-LS | SEQ ID NO: 529 | SEQ ID NO: 469 | SEQ ID NO: 538 |
| 15-22 | ACE2FcPG-740HA201RF/O24A-LS | SEQ ID NO: 518 | SEQ ID NO: 469 | SEQ ID NO: 539 |
| 15-23 | ACE2Fc-740HA201RF/O24A-DHS | SEQ ID NO: 532 | SEQ ID NO: 469 | SEQ ID NO: 540 |
| 15-24 | ACE2FcPG-740HA201RF/O24A-DHS | SEQ ID NO: 522 | SEQ ID NO: 469 | SEQ ID NO: 541 |
| 15-49 | ACE2Fc-740HA201/615HA201RF | SEQ ID NO: 542 | | SEQ ID NO: 543 |
| 15-50 | ACE2Fc-740HA201RF/615HA201 | SEQ ID NO: 524 | | SEQ ID NO: 544 |
| 15-51 | ACE2Fc-740HA201/615HA201RF-YTE | SEQ ID NO: 545 | | SEQ ID NO: 546 |
| 15-52 | ACE2Fc-740HA201RF/615HA201-YTE | SEQ ID NO: 526 | | SEQ ID NO: 547 |
| 15-53 | ACE2Fc-740HA201/615HA201RF-LS | SEQ ID NO: 548 | | SEQ ID NO: 549 |
| 15-54 | ACE2Fc-740HA201RF/615HA201-LS | SEQ ID NO: 529 | | SEQ ID NO: 550 |
| 15-55 | ACE2Fc-740HA201/615HA201RF-DHS | SEQ ID NO: 551 | | SEQ ID NO: 552 |
| 15-56 | ACE2Fc-740HA201RF/615HA201-DHS | SEQ ID NO: 532 | | SEQ ID NO: 553 |

TABLE 34

| | | | | | Fc Domain Type Protein A D1/D2 | |
|---|---|---|---|---|---|---|
| Protein ID | Domain Type D3/D4 | Domain Type D5/D6 | FcR Domain Type D1/D2 | FcRn Domain Type D1/D2 | H1 Chain | H2 Chain |
| 15-01 | ACE2 H378A | ACE2 H378A | L234A/L235A/P329G | | HY | RF |
| 15-02 | ACE2 H378A | ACE2 H378A | L234A/L235A/P329G | | RF | HY |
| 15-03 | ACE2 H378A | ACE2 H378A | L234A/L235A/P329G | M252Y/S254T/T256E | HY | RF |
| 15-04 | ACE2 H378A | ACE2 H378A | L234A/L235A/P329G | M252Y/S254T/T256E | RF | HY |
| 15-05 | ACE2 H378A | ACE2 H378A | L234A/L235A/P329G | M428L/N434S | HY | RF |
| 15-06 | ACE2 H378A | ACE2 H378A | L234A/L235A/P329G | M428L/N434S | RF | HY |
| 15-07 | ACE2 H378A | ACE2 H378A | L234A/L235A/P329G | FCΓL309D/Q311H/N434S | HY | RF |
| 15-08 | ACE2 H378A | ACE2 H378A | L234A/L235A/P329G | FCΓL309D/Q311H/N434S | RF | HY |
| 15-09 | ACE2 H378A | B13A | | | RF | HY |
| 15-10 | ACE2 H378A | B13A | L234A/L235A/P329G | | RF | HY |
| 15-11 | ACE2 H378A | B13A | | M252Y/S254T/T256E | RF | HY |
| 15-12 | ACE2 H378A | B13A | L234A/L235A/P329G | M252Y/S254T/T256E | RF | HY |
| 15-13 | ACE2 H378A | B13A | | M428L/N434S | RF | HY |
| 15-14 | ACE2 H378A | B13A | L234A/L235A/P329G | M428L/N434S | RF | HY |
| 15-15 | ACE2 H378A | B13A | | FCTL309D/Q311H/N434S | RF | HY |
| 15-16 | ACE2 H378A | B13A | L234A/L235A/P329G | FCTL309D/Q311H/N434S | RF | HY |
| 15-17 | ACE2 H378A | O24A | | | RF | HY |
| 15-18 | ACE2 H378A | O24A | L234A/L235A/P329G | | RF | HY |
| 15-19 | ACE2 H378A | O24A | | M252Y/S254T/T256E | RF | HY |
| 15-20 | ACE2 H378A | O24A | L234A/L235A/P329G | M252Y/S254T/T256E | RF | HY |
| 15-21 | ACE2 H378A | O24A | | M428L/N434S | RF | HY |
| 15-22 | ACE2 H378A | O24A | L234A/L235A/P329G | M428L/N434S | RF | HY |
| 15-23 | ACE2 H378A | O24A | | FCΓL309D/Q311H/N434S | RF | HY |
| 15-24 | ACE2 H378A | O24A | L234A/L235A/P329G | FCΓL309D/Q311H/N434S | RF | HY |
| 15-49 | ACE2 H378A | ACE2 H378A | | | HY | RF |
| 15-50 | ACE2 H378A | ACE2 H378A | | | RF | HY |
| 15-51 | ACE2 H378A | ACE2 H378A | | M252Y/S254T/T256E | HY | RF |
| 15-52 | ACE2 H378A | ACE2 H378A | | M252Y/S254T/T256E | RF | HY |
| 15-53 | ACE2 H378A | ACE2 H378A | | M428L/N434S | HY | RF |

TABLE 34-continued

| Protein ID | Domain Type D3/D4 | Domain Type D5/D6 | FcR Domain Type D1/D2 | FcRn Domain Type D1/D2 | Fc Domain Type Protein A D1/D2 H1 Chain | Fc Domain Type Protein A D1/D2 H2 Chain |
|---|---|---|---|---|---|---|
| 15-54 | ACE2 H378A | ACE2 H378A | | M428L/N434S | RF | HY |
| 15-55 | ACE2 H378A | ACE2 H378A | | FCΓL309D/Q311H/N434S | HY | RF |
| 15-56 | ACE2 H378A | ACE2 H378A | | FCΓL309D/Q311H/N434S | RF | HY |

TABLE 35A

| Protein | FcR Domain Type | FcRn Domain Type | FcgRI_CD64 | | | |
|---|---|---|---|---|---|---|
| ID | D1/D2 | D1/D2 | ka (M-1 s-1) | kd (s-1) | KD (M) | Rmax (RU) |
| 15-01 | L234A/L235A/P329G | | NB | NB | NB | NB |
| 15-02 | L234A/L235A/P329G | | NB | NB | NB | NB |
| 15-03 | L234A/L235A/P329G | M252Y/S254T/T256E | NB | NB | NB | NB |
| 15-04 | L234A/L235A/P329G | M252Y/S254T/T256E | NB | NB | NB | NB |
| 15-05 | L234A/L235A/P329G | M428L/N434S | NB | NB | NB | NB |
| 15-06 | L234A/L235A/P329G | M428L/N434S | NB | NB | NB | NB |
| 15-07 | L234A/L235A/P329G | L309D/Q311H/N434S | NB | NB | NB | NB |
| 15-08 | L234A/L235A/P329G | L309D/Q311H/N434S | NB | NB | NB | NB |
| 15-09 | | | 9.71E+05 | 7.44E−04 | 7.67E−10 | 3.61E+01 |
| 15-10 | L234A/L235A/P329G | | NB | NB | NB | NB |
| 15-11 | | M252Y/S254T/T256E | 7.62E+05 | 1.20E−03 | 1.57E−09 | 3.64E+01 |
| 15-12 | L234A/L235A/P329G | M252Y/S254T/T256E | NB | NB | NB | NB |
| 15-13 | | M428L/N434S | 8.29E+05 | 5.83E−04 | 7.02E−10 | 5.34E+01 |
| 15-14 | L234A/L235A/P329G | M428L/N434S | NB | NB | NB | NB |
| 15-15 | | L309D/Q311H/N434S | 7.40E+05 | 7.25E−04 | 9.80E−10 | 6.05E+01 |
| 15-16 | L234A/L235A/P329G | L309D/Q311H/N434S | NB | NB | NB | NB |
| 15-17 | | | 6.94E+05 | 7.16E−04 | 1.03E−09 | 4.37E+01 |
| 15-18 | L234A/L235A/P329G | | NB | NB | NB | NB |
| 15-19 | | M252Y/S254T/T256E | 7.07E+05 | 1.57E−03 | 2.22E−09 | 2.90E+01 |
| 15-20 | L234A/L235A/P329G | M252Y/S254T/T256E | NB | NB | NB | NB |
| 15-21 | | M428L/N434S | 8.87E+05 | 6.72E−04 | 7.58E−10 | 2.97E+01 |
| 15-22 | L234A/L235A/P329G | M428L/N434S | NB | NB | NB | NB |
| 15-23 | | L309D/Q311H/N434S | 9.08E+05 | 6.81E−04 | 7.50E−10 | 3.84E+01 |
| 15-24 | L234A/L235A/P329G | L309D/Q311H/N434S | NB | NB | NB | NB |
| 15-49 | | | 9.04E+05 | 7.02E−04 | 7.76E−10 | 4.87E+01 |
| 15-50 | | | 1.01E+06 | 7.62E−04 | 7.52E−10 | 3.05E+01 |
| 15-51 | | M252Y/S254T/T256E | 9.34E+05 | 1.10E−03 | 1.18E−09 | 2.28E+01 |
| 15-52 | | M252Y/S254T/T256E | 8.54E+05 | 1.17E−03 | 1.37E−09 | 2.69E+01 |
| 15-53 | | M428L/N434S | 9.99E+05 | 6.98E−04 | 6.98E−10 | 2.21E+01 |
| 15-54 | | M428L/N434S | NB | NB | NB | NB |
| 15-56 | | L309D/Q311H/N434S | 7.74E+05 | 9.16E−04 | 1.18E−09 | 3.76E+01 |

TABLE 35B

| Protein | FcR Domain Type | FcRn Domain Type | FcgRIIa (131 R)_CD 32a 131 R | | | |
|---|---|---|---|---|---|---|
| ID | D1/D2 | D1/D2 | ka (M−1 s−1) | kd (s−1) | KD (M) | Rmax (RU) |
| 15-01 | L234A/L235A/P329G | | NB | NB | NB | NB |
| 15-02 | L234A/L235A/P329G | | NB | NB | NB | NB |
| 15-03 | L234A/L235A/P329G | M252Y/S254T/T256E | NB | NB | NB | NB |
| 15-04 | L234A/L235A/P329G | M252Y/S254T/T256E | NB | NB | NB | NB |
| 15-05 | L234A/L235A/P329G | M428L/N434S | NB | NB | NB | NB |
| 15-06 | L234A/L235A/P329G | M428L/N434S | NB | NB | NB | NB |
| 15-07 | L234A/L235A/P329G | L309D/Q311H/N434S | NB | NB | NB | NB |
| 15-08 | L234A/L235A/P329G | L309D/Q311H/N434S | NB | NB | NB | NB |
| 15-09 | | | 1.56E+06 | 3.97E−02 | 2.55E−08 | 3.33E+01 |
| 15-10 | L234A/L235A/P329G | | NB | NB | NB | NB |
| 15-11 | | M252Y/S254T/T256E | 7.26E+05 | 1.12E−01 | 1.54E−07 | 2.79E+01 |
| 15-12 | L234A/L235A/P329G | M252Y/S254T/T256E | NB | NB | NB | NB |
| 15-13 | | M428L/N434S | 1.37E+06 | 1.98E−02 | 1.44E−08 | 4.03E+01 |
| 15-14 | L234A/L235A/P329G | M428L/N434S | NB | NB | NB | NB |
| 15-15 | | L309D/Q311H/N434S | 9.86E+05 | 2.31E−02 | 2.34E−08 | 4.57E+01 |

TABLE 35B-continued

| Protein | FcR Domain Type | FcRn Domain Type | FcgRIIa (131 R)_CD 32a 131 R | | | |
|---|---|---|---|---|---|---|
| ID | D1/D2 | D1/D2 | ka (M−1 s−1) | kd (s−1) | KD (M) | Rmax (RU) |
| 15-16 | L234A/L235A/P329G | L309D/Q311H/N434S | NB | NB | NB | NB |
| 15-17 | | | 8.83E+05 | 4.35E−02 | 4.93E−08 | 1.37E+01 |
| 15-18 | L234A/L235A/P329G | | NB | NB | NB | NB |
| 15-19 | | M252Y/S254T/T256E | 7.19E+05 | 1.98E−01 | 2.76E−07 | 1.65E+01 |
| 15-20 | L234A/L235A/P329G | M252Y/S254T/T256E | NB | NB | NB | NB |
| 15-21 | | M428L/N434S | 1.55E+06 | 7.79E−02 | 5.03E−08 | 2.06E+01 |
| 15-22 | L234A/L235A/P329G | M428L/N434S | NB | NB | NB | NB |
| 15-23 | | L309D/Q311H/N434S | 1.66E+06 | 8.06E−02 | 4.86E−08 | 1.98E+01 |
| 15-24 | L234A/L235A/P329G | L309D/Q311H/N434S | NB | NB | NB | NB |
| 15-49 | | | 1.32E+06 | 3.65E−02 | 2.76E−08 | 3.33E+01 |
| 15-50 | | | 2.03E+06 | 7.99E−02 | 3.94E−08 | 1.91E+01 |
| 15-51 | | M252Y/S254T/T256E | NB | NB | NB | NB |
| 15-52 | | M252Y/S254T/T256E | 1.14E+06 | 2.08E−01 | 1.82E−07 | 1.67E+01 |
| 15-53 | | M428L/N434S | NB | NB | NB | NB |
| 15-54 | | M428L/N434S | NB | NB | NB | NB |
| 15-56 | | L309D/Q311H/N434S | 1.13E+06 | 6.80E−02 | 6.00E−08 | 2.08E+01 |

TABLE 35C

| Protein | FcR Domain Type | FcRn Domain Type | FcgRIIb/c_CD32b/c | | | |
|---|---|---|---|---|---|---|
| ID | D1/D2 | D1/D2 | ka (M−1 s−1) | kd (s−1) | KD (M) | Rmax (RU) |
| 15-01 | L234A/L235A/P329G | | NB | NB | NB | NB |
| 15-02 | L234A/L235A/P329G | | NB | NB | NB | NB |
| 15-03 | L234A/L235A/P329G | M252Y/S254T/T256E | NB | NB | NB | NB |
| 15-04 | L234A/L235A/P329G | M252Y/S254T/T256E | NB | NB | NB | NB |
| 15-05 | L234A/L235A/P329G | M428L/N434S | NB | NB | NB | NB |
| 15-06 | L234A/L235A/P329G | M428L/N434S | NB | NB | NB | NB |
| 15-07 | L234A/L235A/P329G | L309D/Q311H/N434S | NB | NB | NB | NB |
| 15-08 | L234A/L235A/P329G | L309D/Q311H/N434S | NB | NB | NB | NB |
| 15-09 | | | 1.75E+06 | 2.87E−01 | 1.64E−07 | 2.27E+01 |
| 15-10 | L234A/L235A/P329G | | NB | NB | NB | NB |
| 15-11 | | M252Y/S254T/T256E | NB | NB | NB | NB |
| 15-12 | L234A/L235A/P329G | M252Y/S254T/T256E | NB | NB | NB | NB |
| 15-13 | | M428L/N434S | 1.63E+06 | 2.16E−01 | 1.32E−07 | 3.42E+01 |
| 15-14 | L234A/L235A/P329G | M428L/N434S | NB | NB | NB | NB |
| 15-15 | | L309D/Q311H/N434S | 1.26E+06 | 1.99E−01 | 1.57E−07 | 3.67E+01 |
| 15-16 | L234A/L235A/P329G | L309D/Q311H/N434S | NB | NB | NB | NB |
| 15-17 | | | NB | NB | NB | NB |
| 15-18 | L234A/L235A/P329G | | NB | NB | NB | NB |
| 15-19 | | M252Y/S254T/T256E | NB | NB | NB | NB |
| 15-20 | L234A/L235A/P329G | M252Y/S254T/T256E | NB | NB | NB | NB |
| 15-21 | | M428L/N434S | 1.55E+06 | 3.46E−01 | 2.23E−07 | 1.62E+01 |
| 15-22 | L234A/L235A/P329G | M428L/N434S | NB | NB | NB | NB |
| 15-23 | | L309D/Q311H/N434S | NB | NB | NB | NB |
| 15-24 | L234A/L235A/P329G | L309D/Q311H/N434S | NB | NB | NB | NB |
| 15-49 | | | 1.65E+06 | 2.89E−01 | 1.75E−07 | 2.27E+01 |
| 15-50 | | | NB | NB | NB | NB |
| 15-51 | | M252Y/S254T/T256E | NB | NB | NB | NB |
| 15-52 | | M252Y/S254T/T256E | NB | NB | NB | NB |
| 15-53 | | M428L/N434S | NB | NB | NB | NB |
| 15-54 | | M428L/N434S | NB | NB | NB | NB |
| 15-56 | | L309D/Q311H/N434S | NB | NB | NB | NB |

TABLE 35D

| Protein | FcR Domain Type | FcRn Domain Type | FcgRIIIa 158 F _ CD 16 a 158 F | | | |
|---|---|---|---|---|---|---|
| ID | D1/D2 | D1/D2 | ka (M−1 s−1) | kd (s−1) | KD (M) | Rmax (RU) |
| 15-01 | L234A/L235A/P329G | | NB | NB | NB | NB |
| 15-02 | L234A/L235A/P329G | | NB | NB | NB | NB |
| 15-03 | L234A/L235A/P329G | M252Y/S254T/T256E | NB | NB | NB | NB |
| 15-04 | L234A/L235A/P329G | M252Y/S254T/T256E | NB | NB | NB | NB |
| 15-05 | L234A/L235A/P329G | M428L/N434S | NB | NB | NB | NB |

TABLE 35D-continued

| Protein | FcR Domain Type | FcRn Domain Type | FcgRIIIa 158 F _ CD 16 a 158 F | | | |
|---|---|---|---|---|---|---|
| ID | D1/D2 | D1/D2 | ka (M−1 s−1) | kd (s−1) | KD (M) | Rmax (RU) |
| 15-06 | L234A/L235A/P329G | M428L/N434S | NB | NB | NB | NB |
| 15-07 | L234A/L235A/P329G | L309D/Q311H/N434S | NB | NB | NB | NB |
| 15-08 | L234A/L235A/P329G | L309D/Q311H/N434S | NB | NB | NB | NB |
| 15-09 | | | 6.98E+04 | 1.13E−01 | 1.61E−06 | 4.14E+01 |
| 15-10 | L234A/L235A/P329G | | NB | NB | NB | NB |
| 15-11 | | M252Y/S254T/T256E | NB | NB | NB | NB |
| 15-12 | L234A/L235A/P329G | M252Y/S254T/T256E | NB | NB | NB | NB |
| 15-13 | | M428L/N434S | 5.92E+04 | 4.97E−02 | 8.40E−07 | 4.41E+01 |
| 15-14 | L234A/L235A/P329G | M428L/N434S | NB | NB | NB | NB |
| 15-15 | | L309D/Q311H/N434S | 6.04E+04 | 6.92E−02 | 1.15E−06 | 4.81E+01 |
| 15-16 | L234A/L235A/P329G | L309D/Q311H/N434S | NB | NB | NB | NB |
| 15-17 | | | NB | NB | NB | NB |
| 15-18 | L234A/L235A/P329G | | NB | NB | NB | NB |
| 15-19 | | M252Y/S254T/T256E | NB | NB | NB | NB |
| 15-20 | L234A/L235A/P329G | M252Y/S254T/T256E | NB | NB | NB | NB |
| 15-21 | | M428L/N434S | NB | NB | NB | NB |
| 15-22 | L234A/L235A/P329G | M428L/N434S | NB | NB | NB | NB |
| 15-23 | | L309D/Q311H/N434S | NB | NB | NB | NB |
| 15-24 | L234A/L235A/P329G | L309D/Q311H/N434S | NB | NB | NB | NB |
| 15-49 | | | 8.90E+04 | 1.04E−01 | 1.17E−06 | 3.38E+01 |
| 15-50 | | | NB | NB | NB | NB |
| 15-51 | | M252Y/S254T/T256E | NB | NB | NB | NB |
| 15-52 | | M252Y/S254T/T256E | NB | NB | NB | NB |
| 15-53 | | M428L/N434S | NB | NB | NB | NB |
| 15-54 | | M428L/N434S | NB | NB | NB | NB |
| 15-56 | | L309D/Q311H/N434S | NB | NB | NB | NB |

TABLE 35E

| Protein | FcR Domain Type | FcRn Domain Type | FcgRIIb/c_CD32b/c FcgRIIIa 158 V _ CD 16 a 158 V | | | |
|---|---|---|---|---|---|---|
| ID | D1/D2 | D1/D2 | ka (M−1 s−1) | kd (s−1) | KD (M) | Rmax (RU) |
| 15-01 | L234A/L235A/P329G | | NB | NB | NB | NB |
| 15-02 | L234A/L235A/P329G | | NB | NB | NB | NB |
| 15-03 | L234A/L235A/P329G | M252Y/S254T/T256E | NB | NB | NB | NB |
| 15-04 | L234A/L235A/P329G | M252Y/S254T/T256E | NB | NB | NB | NB |
| 15-05 | L234A/L235A/P329G | M428L/N434S | NB | NB | NB | NB |
| 15-06 | L234A/L235A/P329G | M428L/N434S | NB | NB | NB | NB |
| 15-07 | L234A/L235A/P329G | L309D/Q311H/N434S | NB | NB | NB | NB |
| 15-08 | L234A/L235A/P329G | L309D/Q311H/N434S | NB | NB | NB | NB |
| 15-09 | | | 1.05E+05 | 3.33E−02 | 3.16E−07 | 3.79E+01 |
| 15-10 | L234A/L235A/P329G | | NB | NB | NB | NB |
| 15-11 | | M252Y/S254T/T256E | NB | NB | NB | NB |
| 15-12 | L234A/L235A/P329G | M252Y/S254T/T256E | NB | NB | NB | NB |
| 15-13 | | M428L/N434S | 9.51E+04 | 2.02E−02 | 2.13E−07 | 4.58E+01 |
| 15-14 | L234A/L235A/P329G | M428L/N434S | NB | NB | NB | NB |
| 15-15 | | L309D/Q311H/N434S | 8.55E+04 | 2.52E−02 | 2.95E−07 | 5.12E+01 |
| 15-16 | L234A/L235A/P329G | L309D/Q311H/N434S | NB | NB | NB | NB |
| 15-17 | | | NB | NB | NB | NB |
| 15-18 | L234A/L235A/P329G | | NB | NB | NB | NB |
| 15-19 | | M252Y/S254T/T256E | NB | NB | NB | NB |
| 15-20 | L234A/L235A/P329G | M252Y/S254T/T256E | NB | NB | NB | NB |
| 15-21 | | M428L/N434S | 1.78E+05 | 3.90E−02 | 2.19E−07 | 2.00E+01 |
| 15-22 | L234A/L235A/P329G | M428L/N434S | NB | NB | NB | NB |
| 15-23 | | L309D/Q311H/N434S | NB | NB | NB | NB |
| 15-24 | L234A/L235A/P329G | L309D/Q311H/N434S | NB | NB | NB | NB |
| 15-49 | | | 1.70E+05 | 3.62E−02 | 2.13E−07 | 3.40E+01 |
| 15-50 | | | NB | NB | NB | NB |
| 15-51 | | M252Y/S254T/T256E | NB | NB | NB | NB |
| 15-52 | | M252Y/S254T/T256E | NB | NB | NB | NB |
| 15-53 | | M428L/N434S | NB | NB | NB | NB |
| 15-54 | | M428L/N434S | NB | NB | NB | NB |
| 15-56 | | L309D/Q311H/N434S | NB | NB | NB | NB |

Example 16—SARS-CoV-2 Variant Neutralization Studies

Tetrahedral antibody constructs 15-15 and 15-16 (ACE2-B13A), 15-23 and 15-24 (ACE2-O24), 15-07 and 15-53 (ACE2-ACE2), and 10-61 and 10-65 (ACE2 core dimer as shown in FIG. 43) were evaluated for activity against a range of antibody-resistant variants of SARS-CoV-2 using a pseudovirus neutralization assay (Integral Molecular, Philadelphia, PA). The 10-61 and 10-65 constructs incorporated the 313 affinity enhancing mutations described in Glasgow et al. PNAS 117:28046-28055 (2020)). Each construct was evaluated against eleven SARS-CoV-2 variants and one SARS-CoV-1 strain, and compared side-by-side with the parent antibodies B13A and 024, and biosimilar versions of eight antibodies that have received Emergency Use Authorization (EUA) by the U.S. Food and Drug Administration (FDA) or are in late-stage clinical trials: REGN10897, REGN10933, Bamlanivimab, Etesevimab, AZD1061, AZD 8895, VIR-7841, and CT-P59.

The SARS-CoV-2 variants tested were D614G B.1 (RVP-702), Californian B.1.427/B.1.429 (RVP-713), Indian B.1.617.2 (RVP-763), South African B.1.351 (RVP-707), South African Δ B.1.351 (RVP-724), N439K (RVP-703), Brazilian P.1 (RVP-708), Nigerian/European B.1.525 (RVP-723), New York B.1.526 (RVP-726), UK B.1.1.7 (RVP-706, and UK B.1.1.7 with E484K (RVP-717). The SARS-CoV-1 variant tested was Urbani (RVP-801). The Integral Molecular catalog numbers are indicated in parentheses.

Figure 48A:
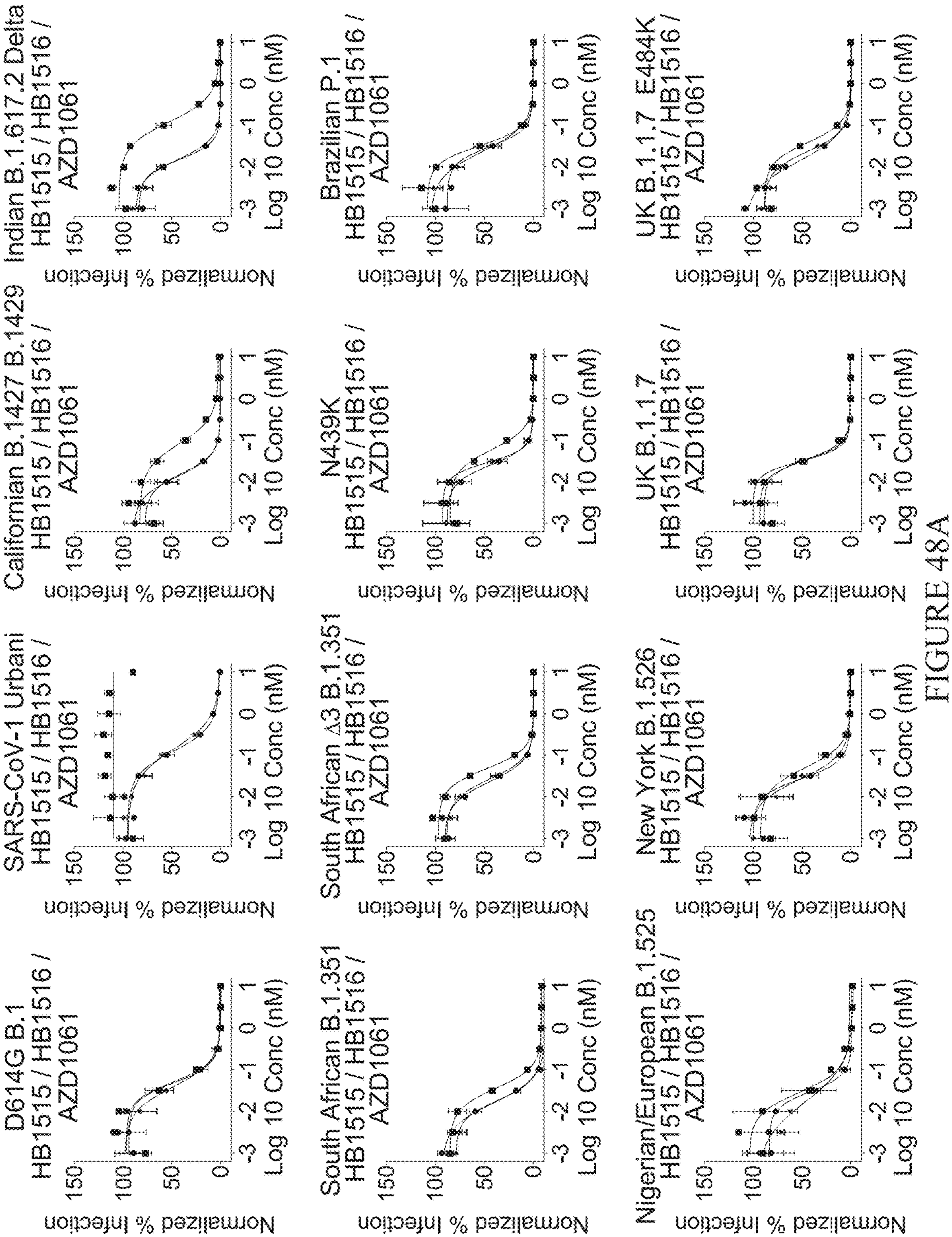
FIG. 48A-FIG. 48P: Relative neutralization activity of various antibodies against 12 different variant viruses is compared to the ACE2-B13 silent version and ACE2-B13 active version (denoted by diamonds and circles).
Figure 48B:
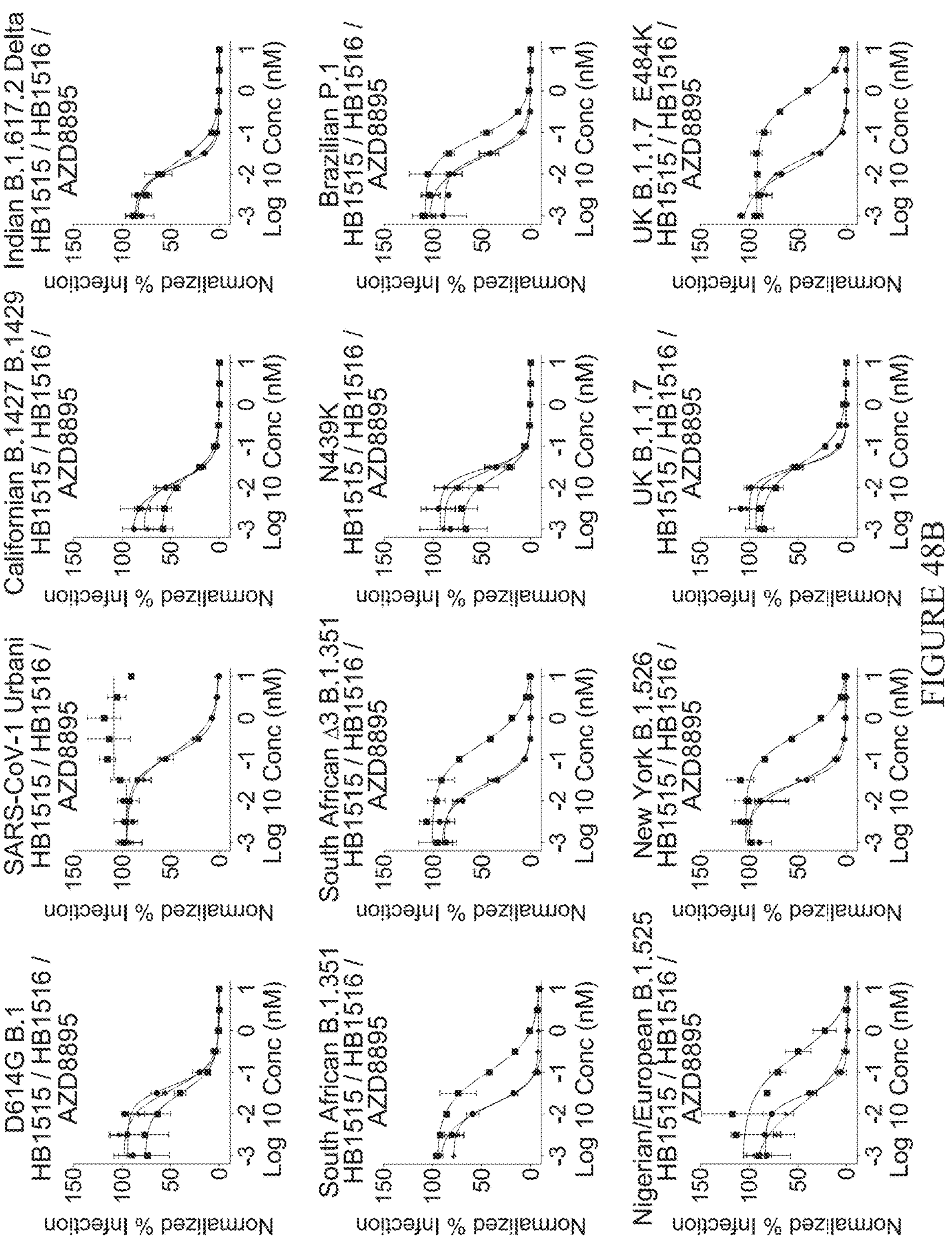
Figure 48C:
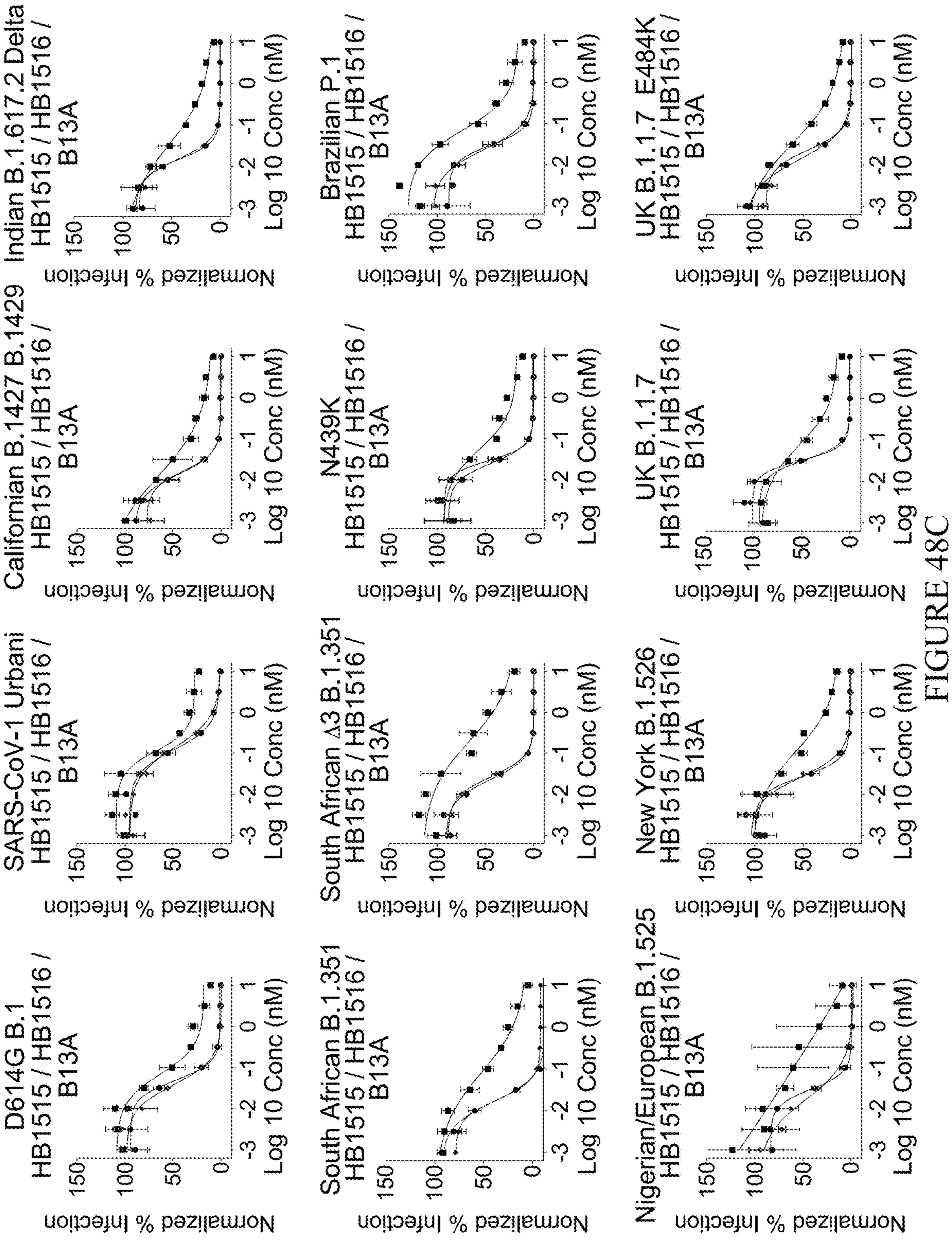
Figure 48D:
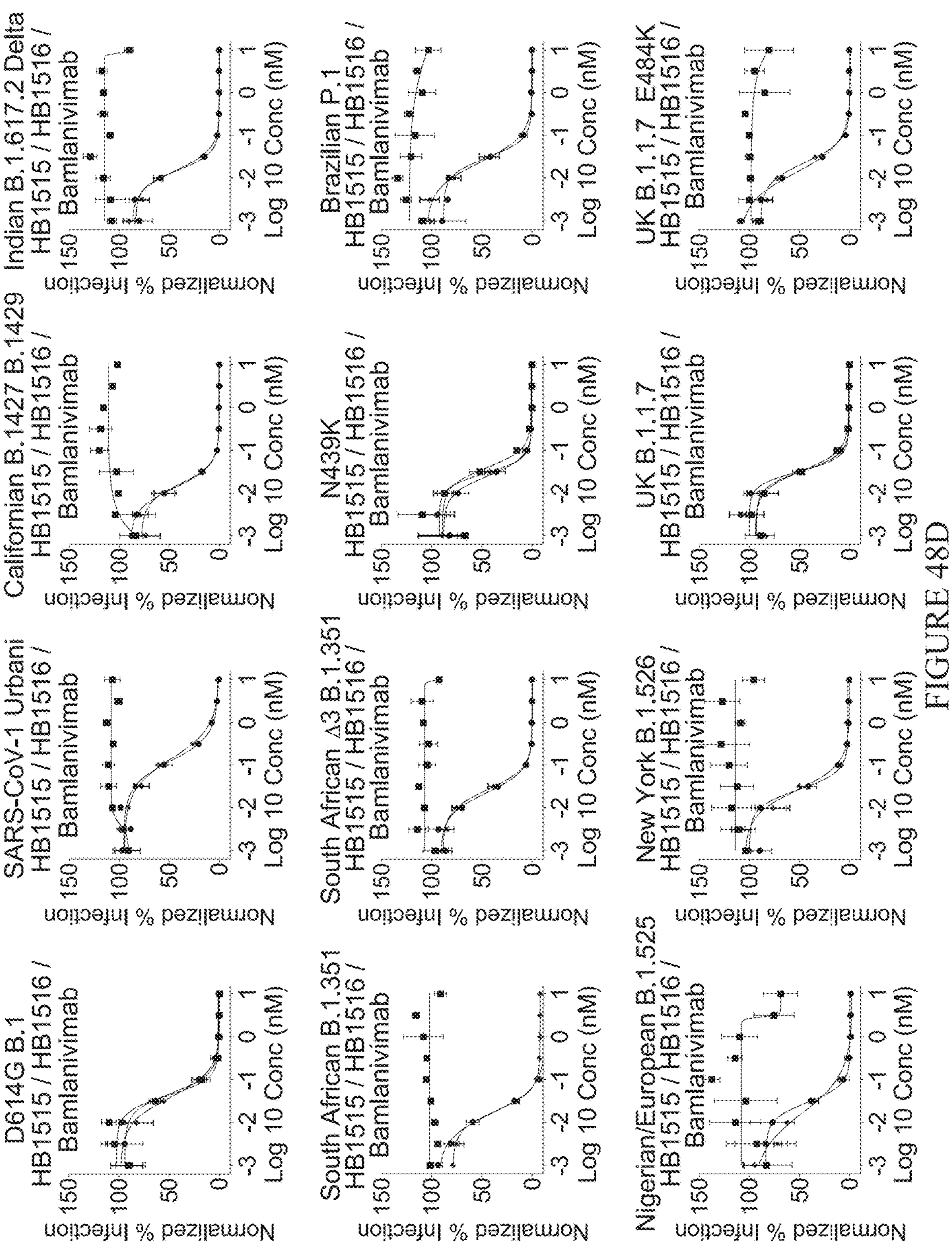
Figure 48E:
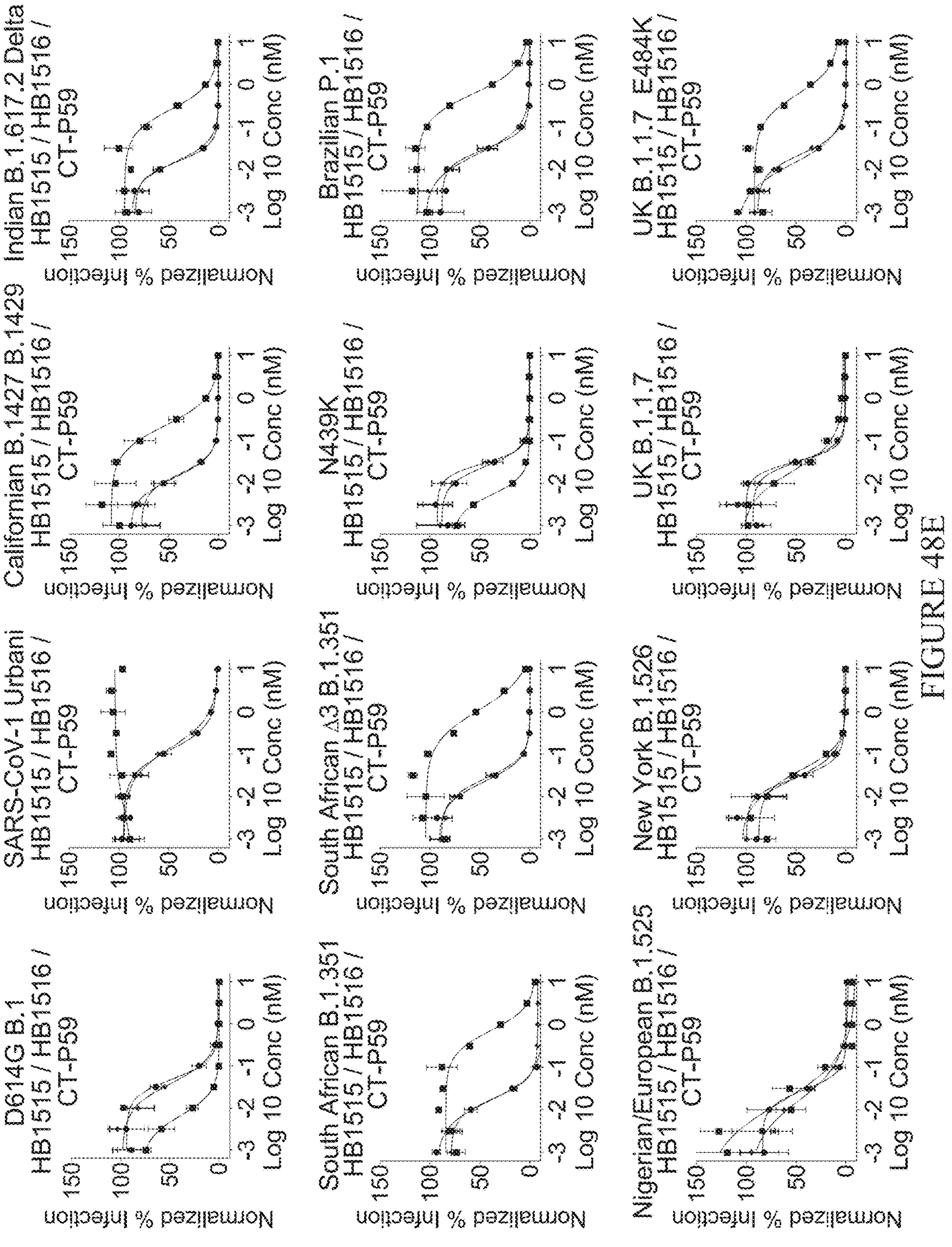
Figure 48F:
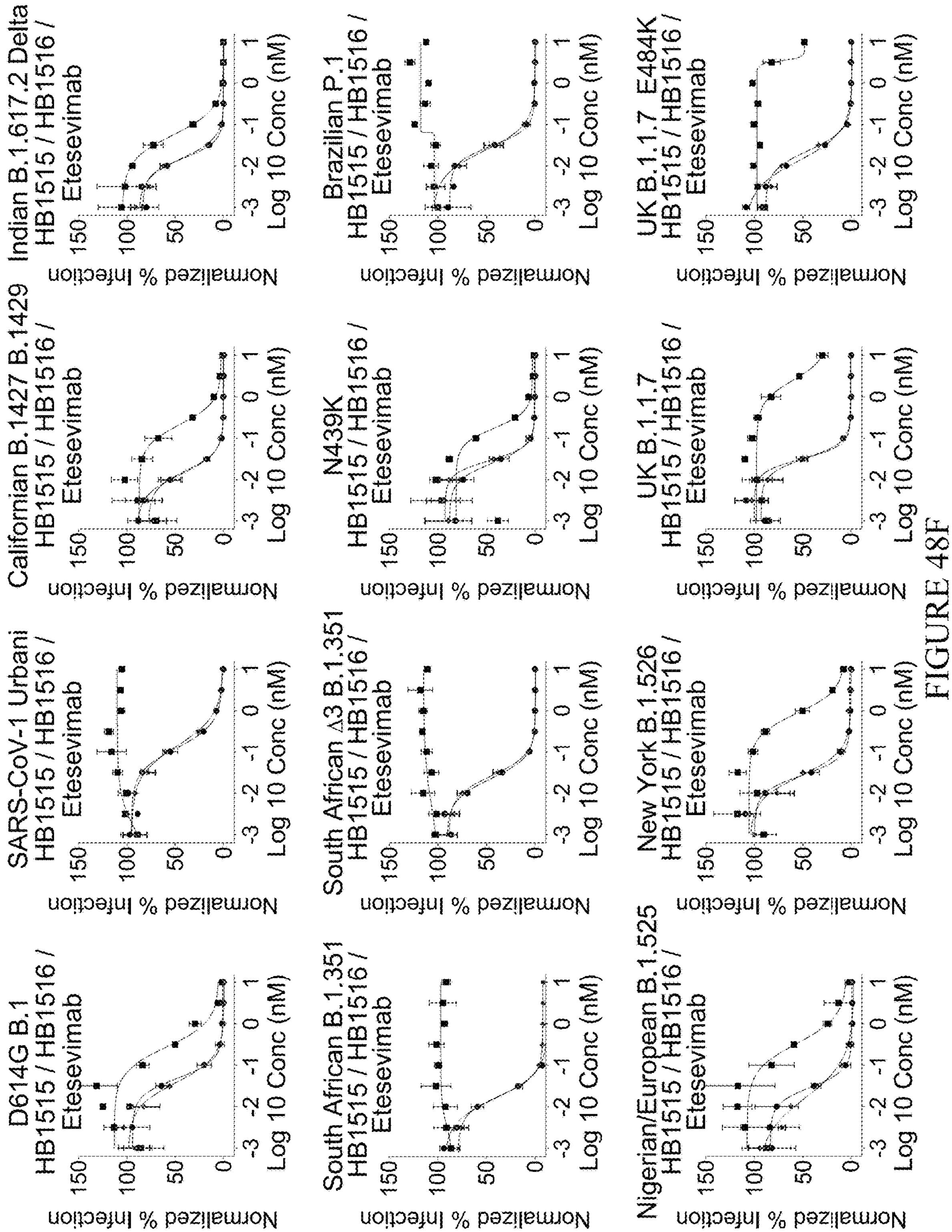
Figure 48G:
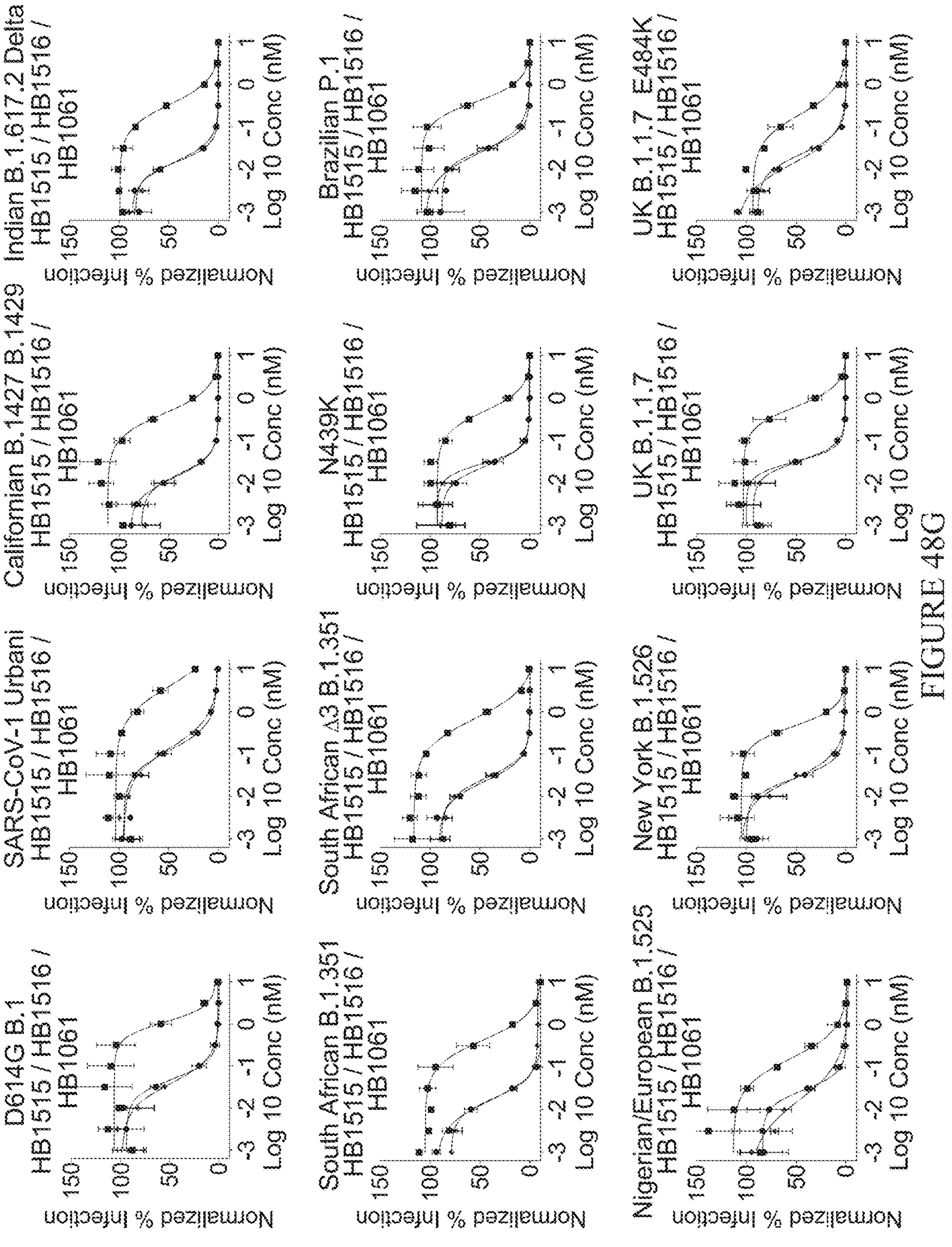
Figure 48H:
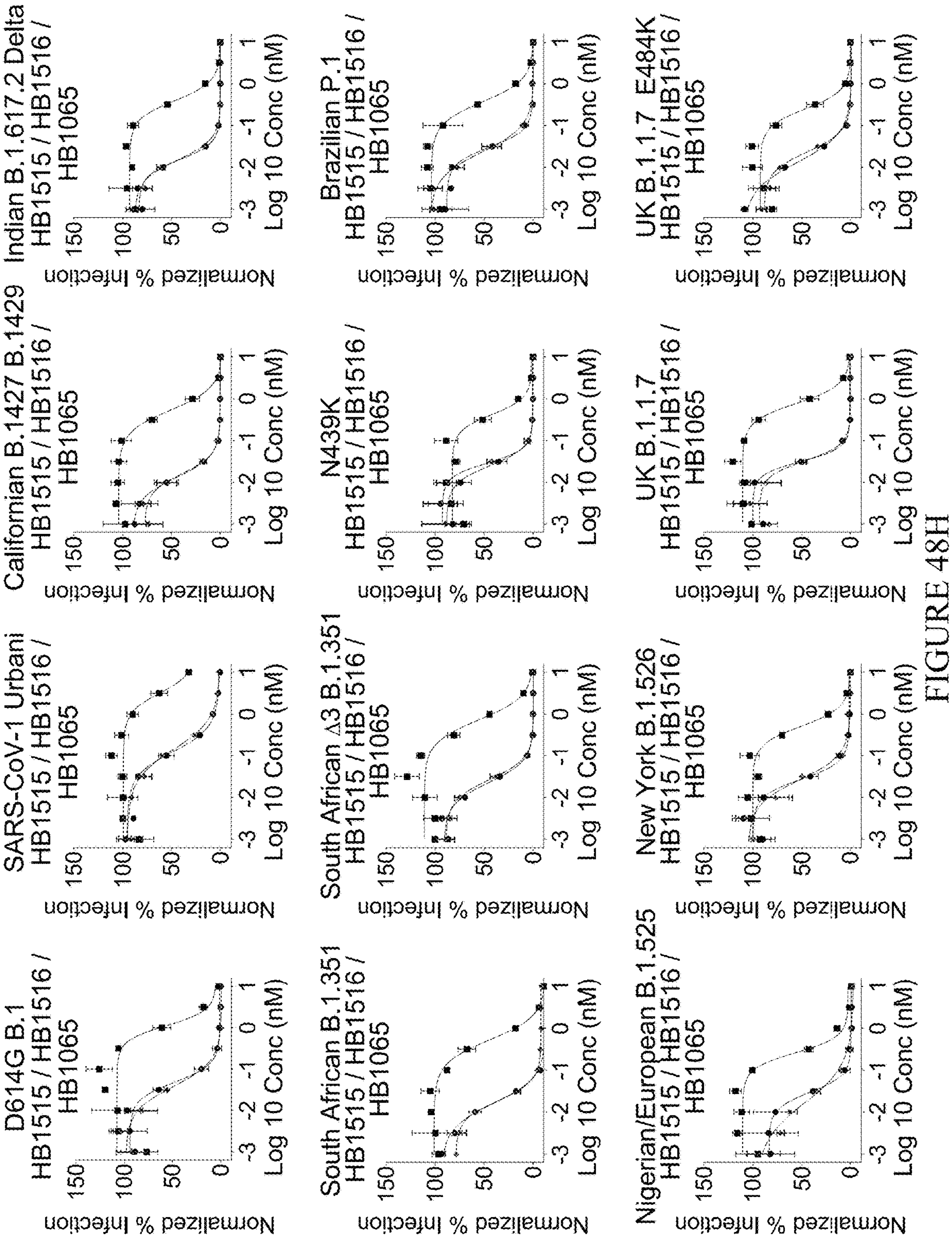
Figure 48I:
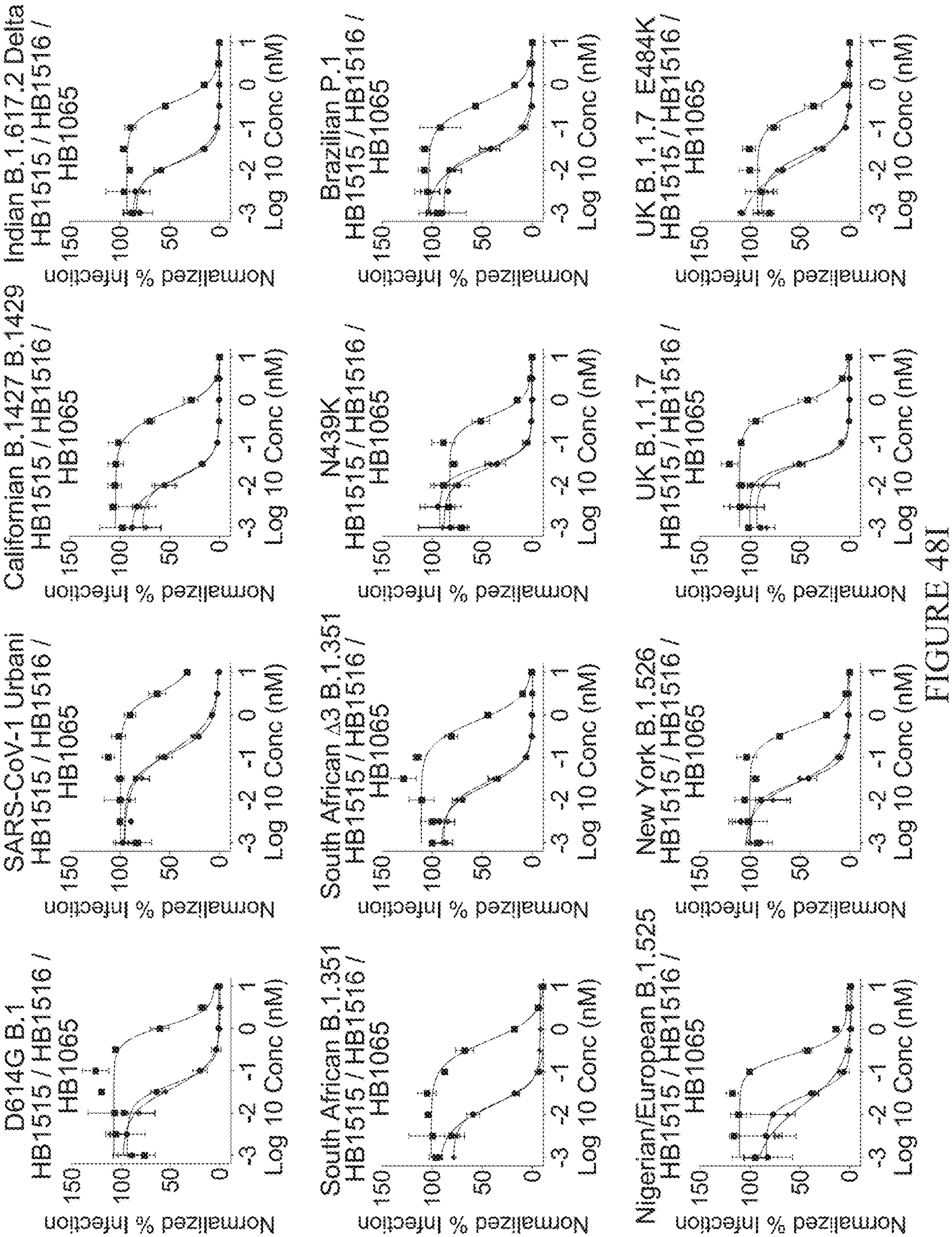
Figure 48J:
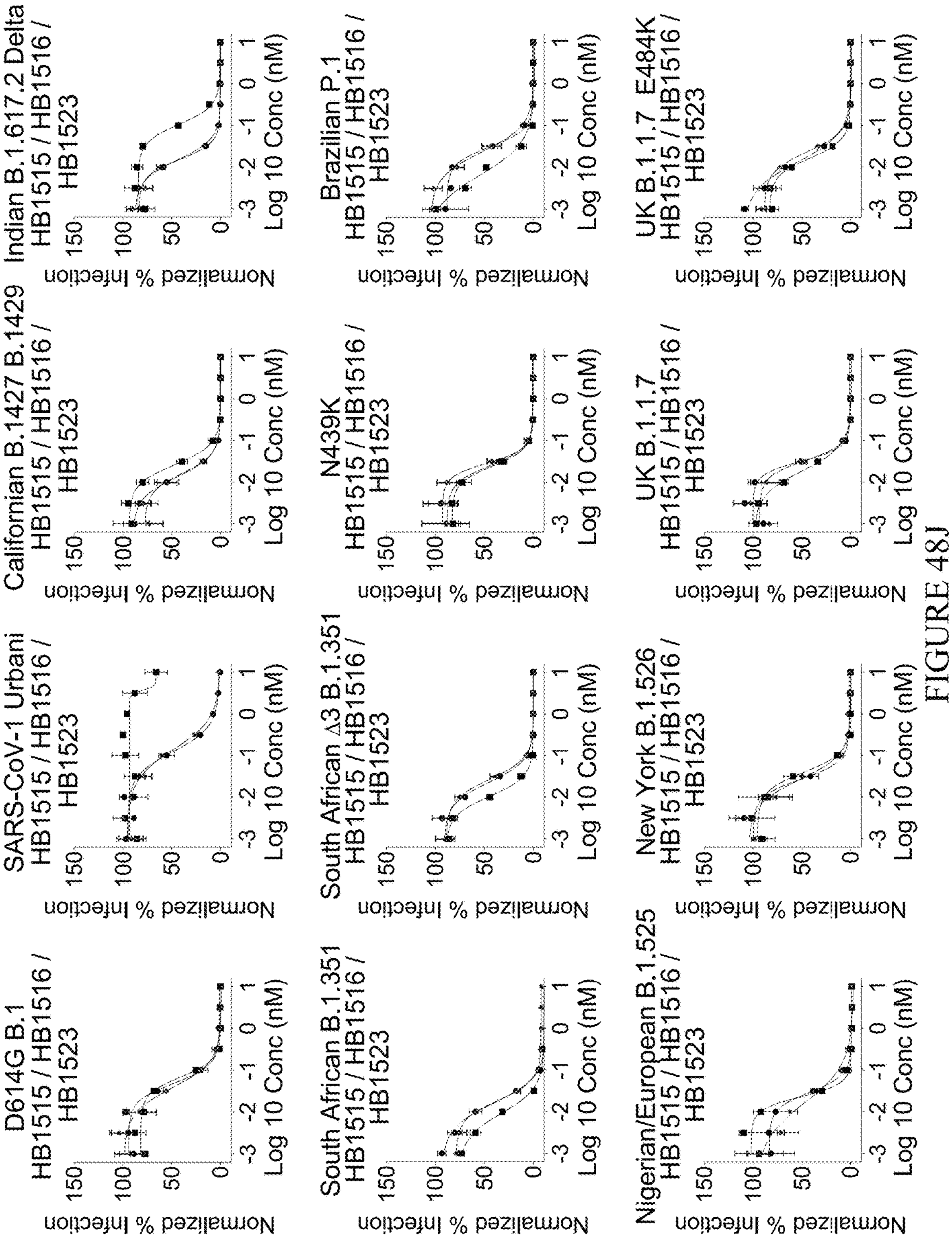
Figure 48K:
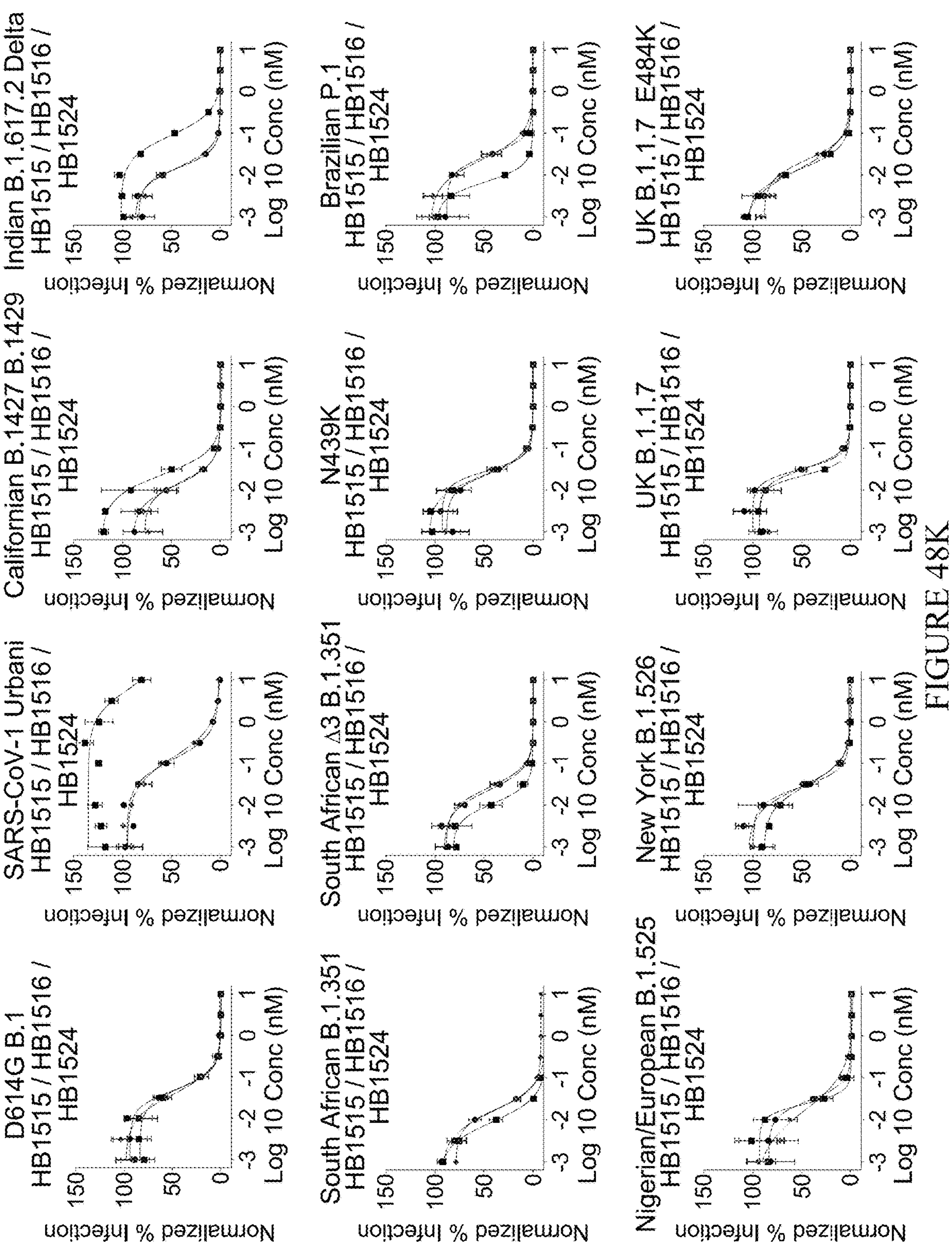
Figure 48L:
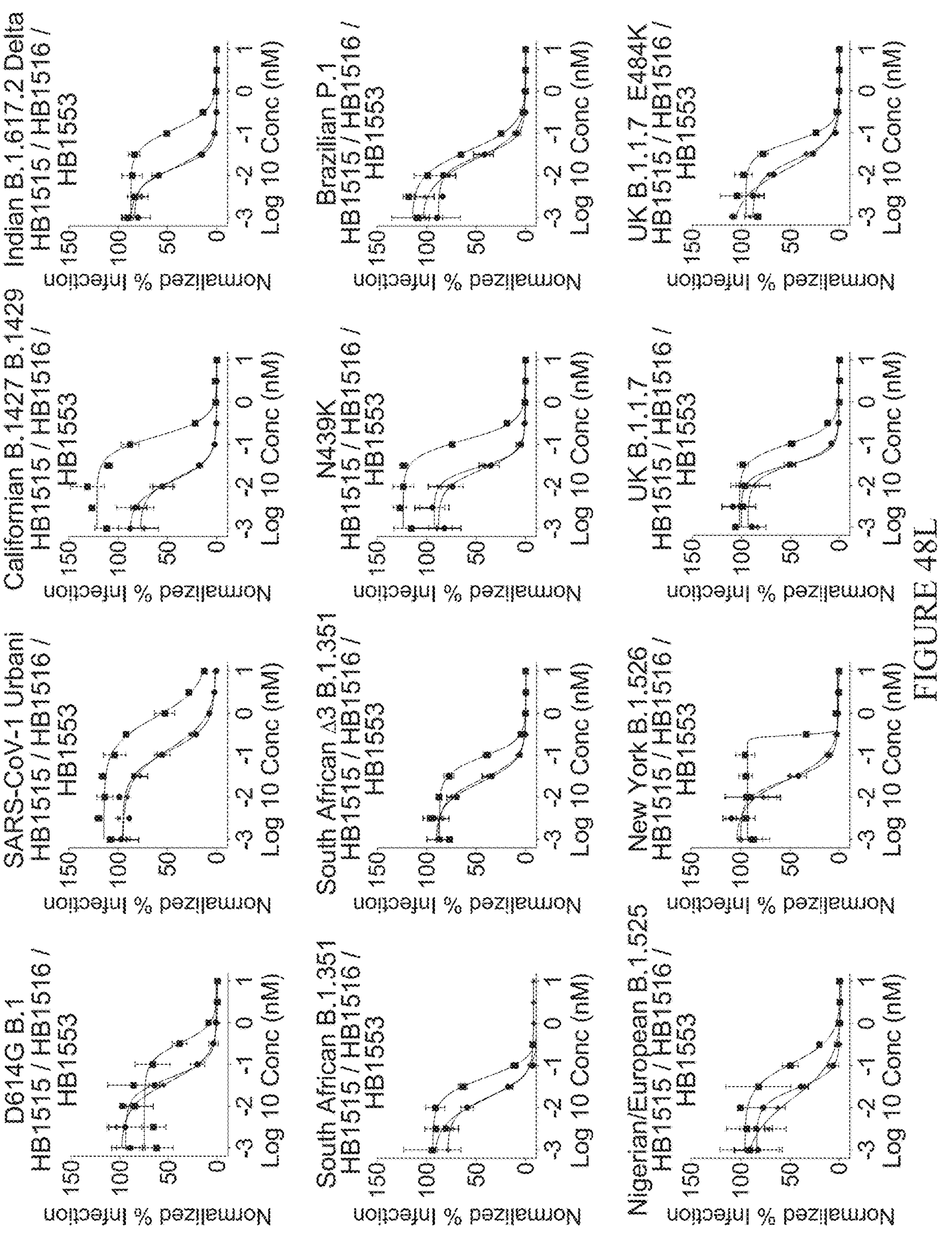
Figure 48M:
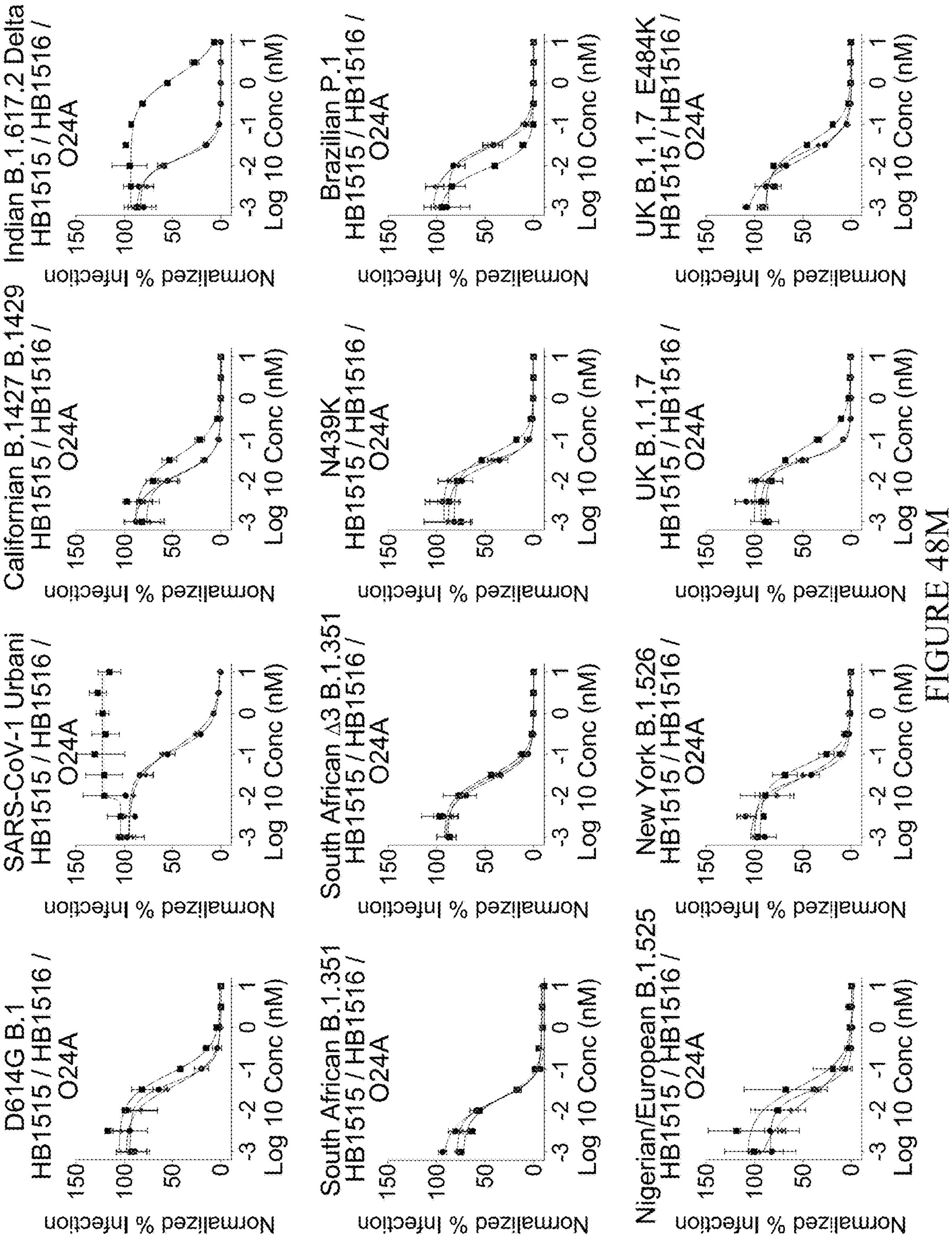
Figure 48N:
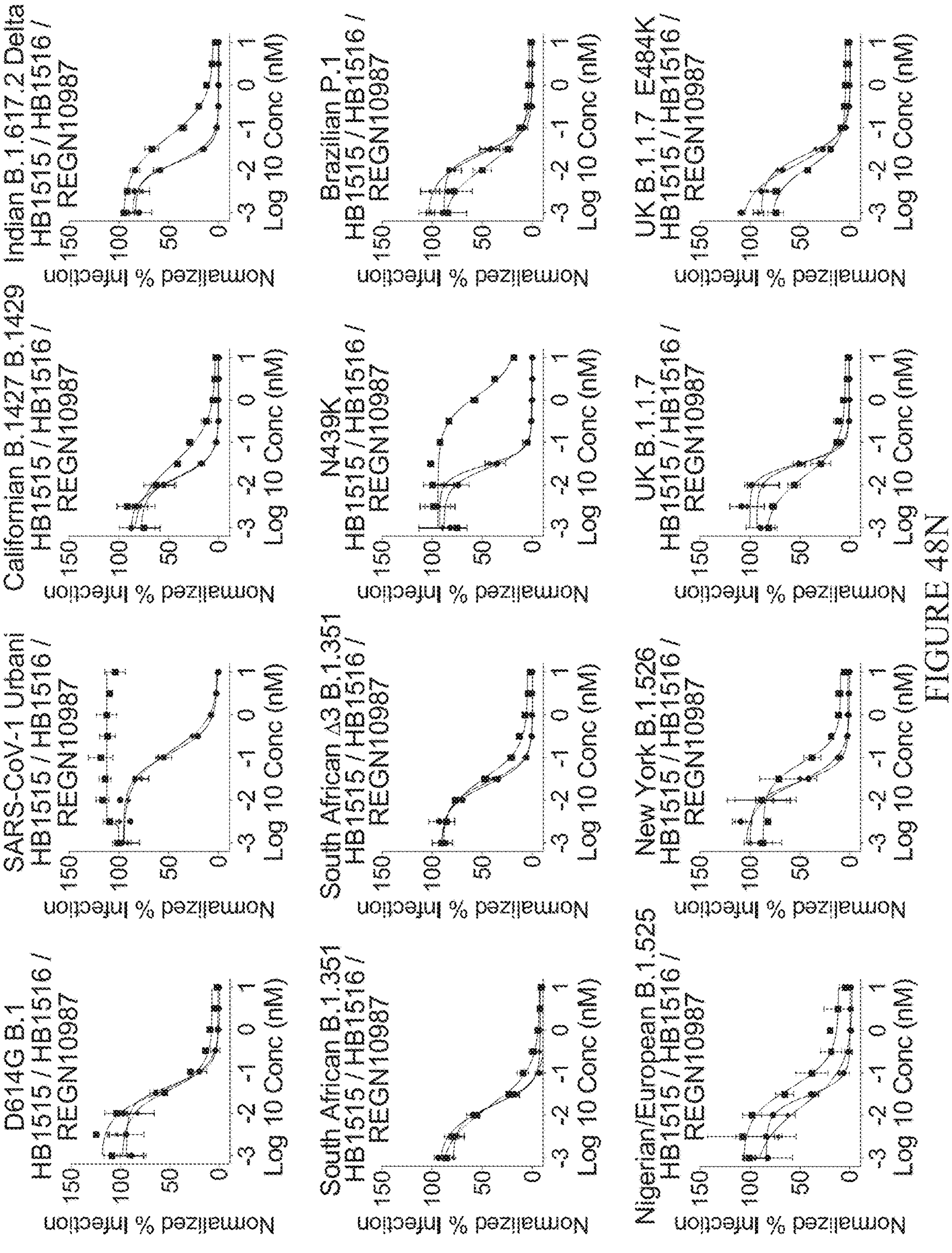
Figure 48O:
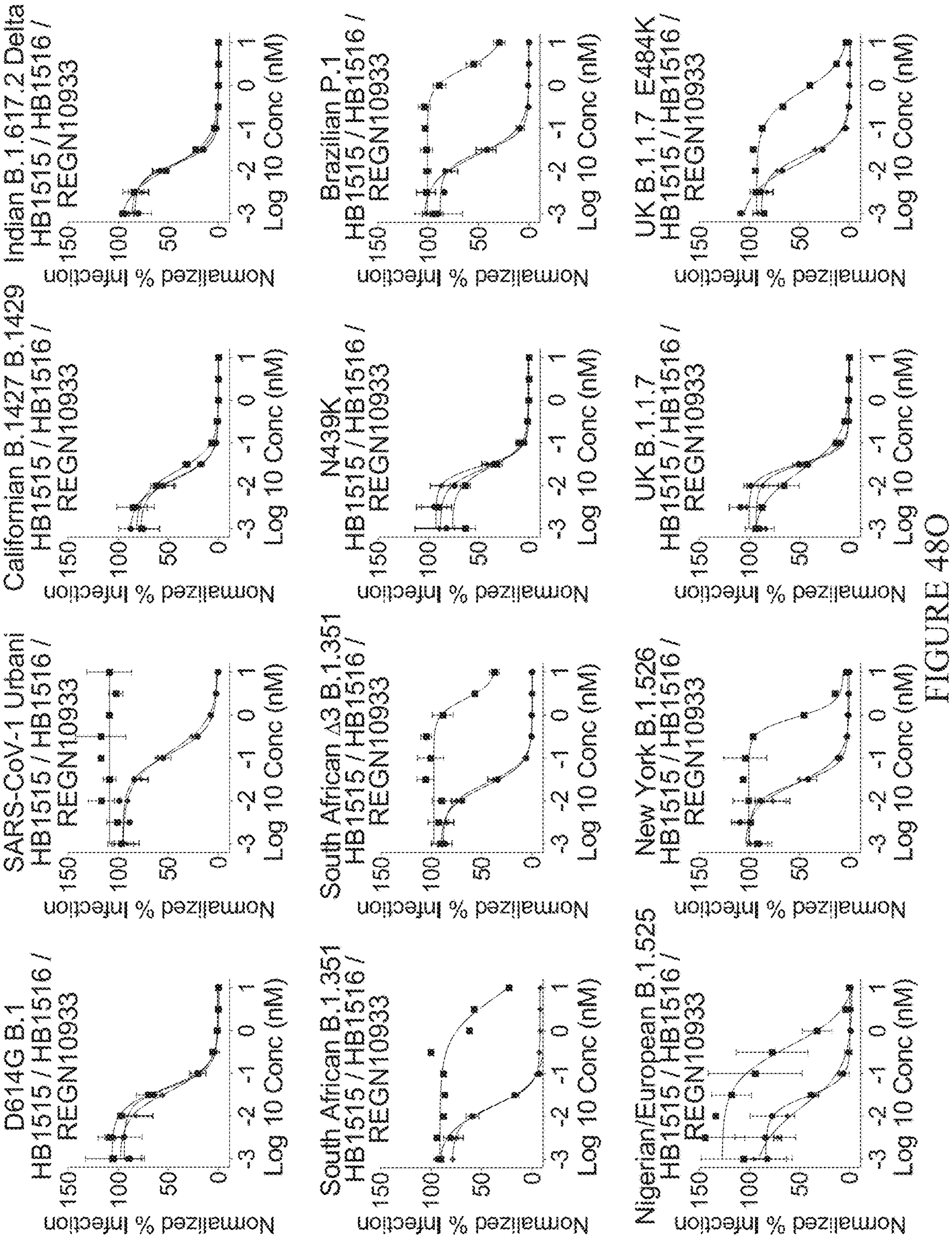
Figure 48P:
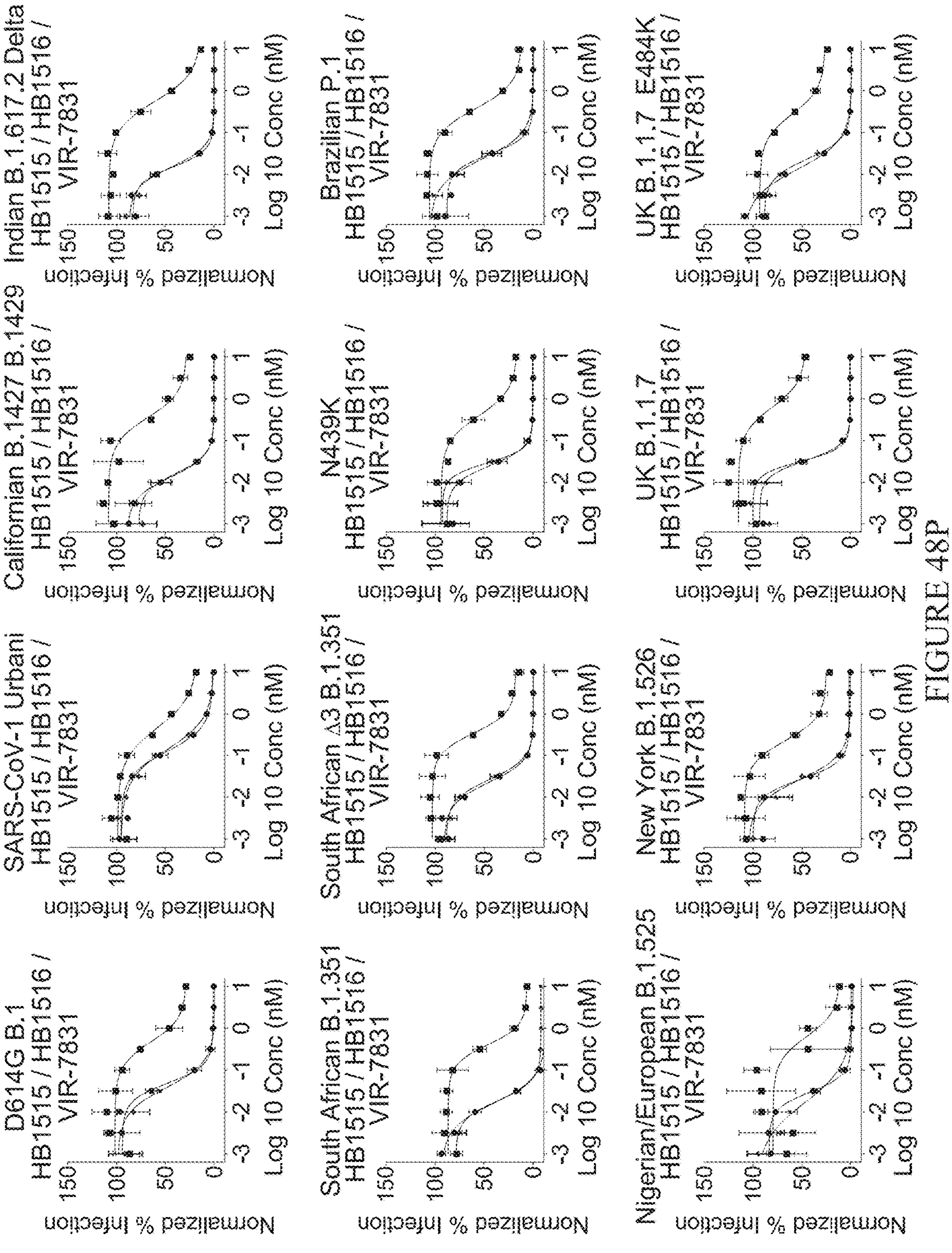

The results are shown in FIGS. 48A-48P. Notably, the tetrahedral antibody constructs HB1515 and HB1516 were effective against all eleven SARS-CoV-2 variants as well as SARS-CoV-1. By contrast, significant viral resistance was observed for all ten antibodies with at least two of the SARS-CoV-2 variants. In addition, HB1515 and HB1516 were at least as potent as all ten of the antibodies tested (with the exception of CT-P59 against the D614G variant).

Methods: SARS-CoV-2 pseudovirus neutralization assay. The neutralization assay was carried out according to the manufacturers' protocols. In brief, serially diluted antibodies were incubated with pseudotyped SARS-CoV-2-*Renilla* Luciferase for 1 hr. at 37° C. At least nine concentrations were tested for each antibody. Pseudovirus in culture media without antibody was used as a negative control to determine 100% infectivity. The mixtures were then incubated with 293T-hsACE2 cells at 2.5×10e5 cells/ml in the 96-well plates. Infection took place over approximately 72 hrs. at 37° C. with 5% CO2. The luciferase signal was measured using the Renilla-Glo luciferase assay system (Promega, Cat #E2710) with the luminometer set at 1 ms integration time. The obtained relative luminescence signals (RLU) from the negative control wells were normalized and used to calculate the neutralization percentage for each concentration. These data were processed by Prism 9 (GraphPad) to fit a 4PL curve and calculate the log $IC_{50}$.

Example 17—Efficacy of Tetrahedral Antibody HB1516 in the Hamster Covid-19 Model A leading animal model for the study of SARS-CoV-2 utilizes Golden Syrian Hamsters to study the pathogenicity and test therapeutics or vaccines. Prior studies using this model have found that SARS-CoV-2 infection of hamsters results in mild to moderate clinical signs (rapid breathing, weight loss, high titers of virus in the upper and lower respiratory tract and histological changes in the lungs) showing similar infectivity and pathology characteristics between hamsters and humans. HB1516 (protein 15-16) was evaluated in a prophylactic version of this model to determine its efficacy in protecting against challenge using the South African variant of SARS-CoV-2 and compared with REGN-CoV-2, a neutralizing antibody cocktail (Regeneron, Tarrytown, N.Y.) consisting of REGN10987 (protein 12-01) and REGN10933 (protein 12-01), which has received an Emergency Use Authorization (EUA) by the U.S. Food and Drug Administration (FDA) and previously demonstrated efficacy in the hamsters (Baum et al, Science 370, 1110-1115 (2020)).

Materials. The South African variant of SARS-CoV-2 virus used for infection was sourced from BEI Resources, American Type Culture Collection (Manassas, VA): Catalog No. NR-54974 (hCoV-19/South Africa/KRISP-K005325/2020). This SARS-CoV-2 variant has the following amino acid mutations in its spike(S) protein with reference to the sequence of the Wuhan-1 isolate (NCBI Reference Sequence: NC_045512.2): L18F, D80A, D215A, L242/A243/L244 deletion, K417N, E484K N501Y, D614G, A701V. The biosimilar versions of REGN10987 and REGN10933 used in this study were produced at Lakepharma Inc. (Belmont, CA).

Methods. The study was conducted at BIOQUAL, Inc. (Rockville, MD). A total of 24 male golden hamsters 6-8 weeks old were assigned to four groups (n=6). Animals were treated with the appropriate material for their group on study day minus one (−1) via the intraperitoneal (IP) route. Test articles were prepared in Dulbecco's Phosphate-Buffered Saline (ATCC No. 30-2020) and administered at the following concentrations: HB1516 (25 mg/kg), REGN10933 (25 mg/kg), and REGN-CoV-2 (25 mg/kg each of REGN10987 and REGN10933).

On study day 0, animals were bled pre-challenge, followed by intranasal challenge with the South Africa SARS-CoV-2 strain. Animals were observed twice daily in the post-challenge phase and their weights were collected daily.

Figure 49:
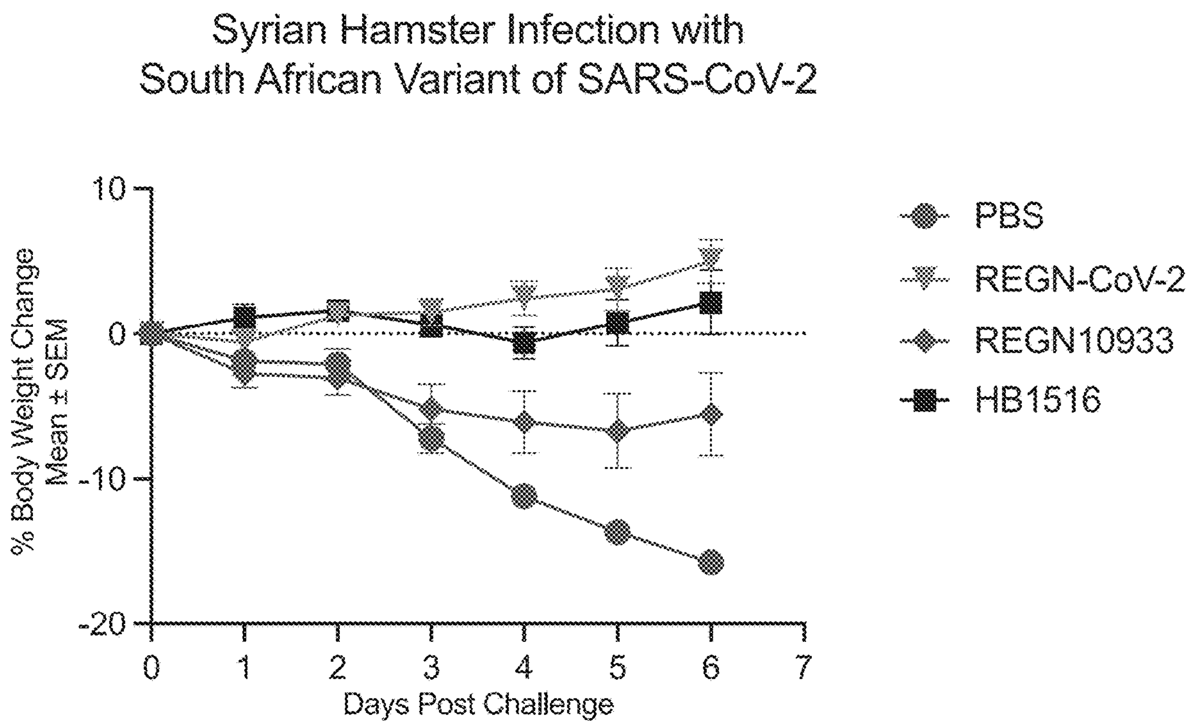
FIG. 49: Body weight change of Hamsters infected with South African SARS-CoV-2 virus treated with PBS control (PBS), 25 mg/kg of REGN10933, and REG-CoV-2 cocktail (25 mg/kg each of Regeneron antibody REGN10933 and REG108987), and 25 mg/kg Fc silent ACE2-B13 (HB1516; protein 15-16).

Results. As shown in FIG. 49, the PBS negative control group lost weight steadily following infection and by day 7 had lost approximately 18% of their starting weight. The HB1516 treated group maintained their weight throughout the study and by day 7 had gained approximately 3% of their starting weight (HB1516 vs. PBS control: p value<0.0001), comparable to results for the REGN-CoV-2 treated group (HB1516 vs. REGN-COV: p value 0.9019). By contrast, the REGN10933 treated group had lost about 7% of their weight through day 5.

Example 18—Tetrahedral Antibodies Comprising Fab Domains of Two Distinct Binding Specificities for SARS-CoV-2 Spike Protein To provide proof-of-principle demonstrating tetrahedral antibodies comprising two distinct types of Fab domain that specifically bind two different targets, two series of constructs were generated with the predicted structure shown in Panel C of FIG. 32, according to Table 36, then evaluated for their structural and functional bispecificity. The first series of constructs employed VH and VL regions from REGN10987 (SEQ ID NOs: 421-422) and REGN10933 (SEQ ID NOs: 423-424); the second series of constructs employed VH and VL regions from B13A (SEQ ID NOs: 463-464) and 024A (SEQ ID NOs: 467-468) (Tables 36 and 37).

To optimize correct VH/VL pairing and to minimize VH/VL mispairing, V region exchange was combined with electrostatic steering (Table 38). Three sets of electrostatically matched mutations were employed. In each series of constructs V region exchange was evaluated in both orientations, e.g., REGN10987/REGN10933 and REGN10933/REGN10987. In each orientation the V regions of the D5/D6 domains were exchanged. Heterodimerization of the H1 and H2 chains was achieved using the Knob-into-Hole approach (knob: T366W/S354C, hole: T366/L368A/Y407V/Y349C). To further facilitate purification of the correctly paired product by Protein A chromatography, either of the H1 or the H2 chain incorporated the H435R/Y436F substitution (Table 37).

The constructs were evaluated for structural bispecificity by intact mass spectrometry. Following removal of N-glycan and O-glycan using Protein Deglycosylation Mix II (NEB, Ipswich, MA), samples were analyzed under non-reducing, denaturing conditions by LS/MS on a Maxis II UHR QTOF instrument following size-exclusion chromatography (Bruker, Billerica, MA). One to five ug of each sample was injected at a flowrate of 20 uL in a mobile phase consisting of a 10 min gradient of water with 180 mM ammonium acetate at room temperature. A full scan MS acquisition method was used with a mass resolution of 10,000.

Figure 50A:
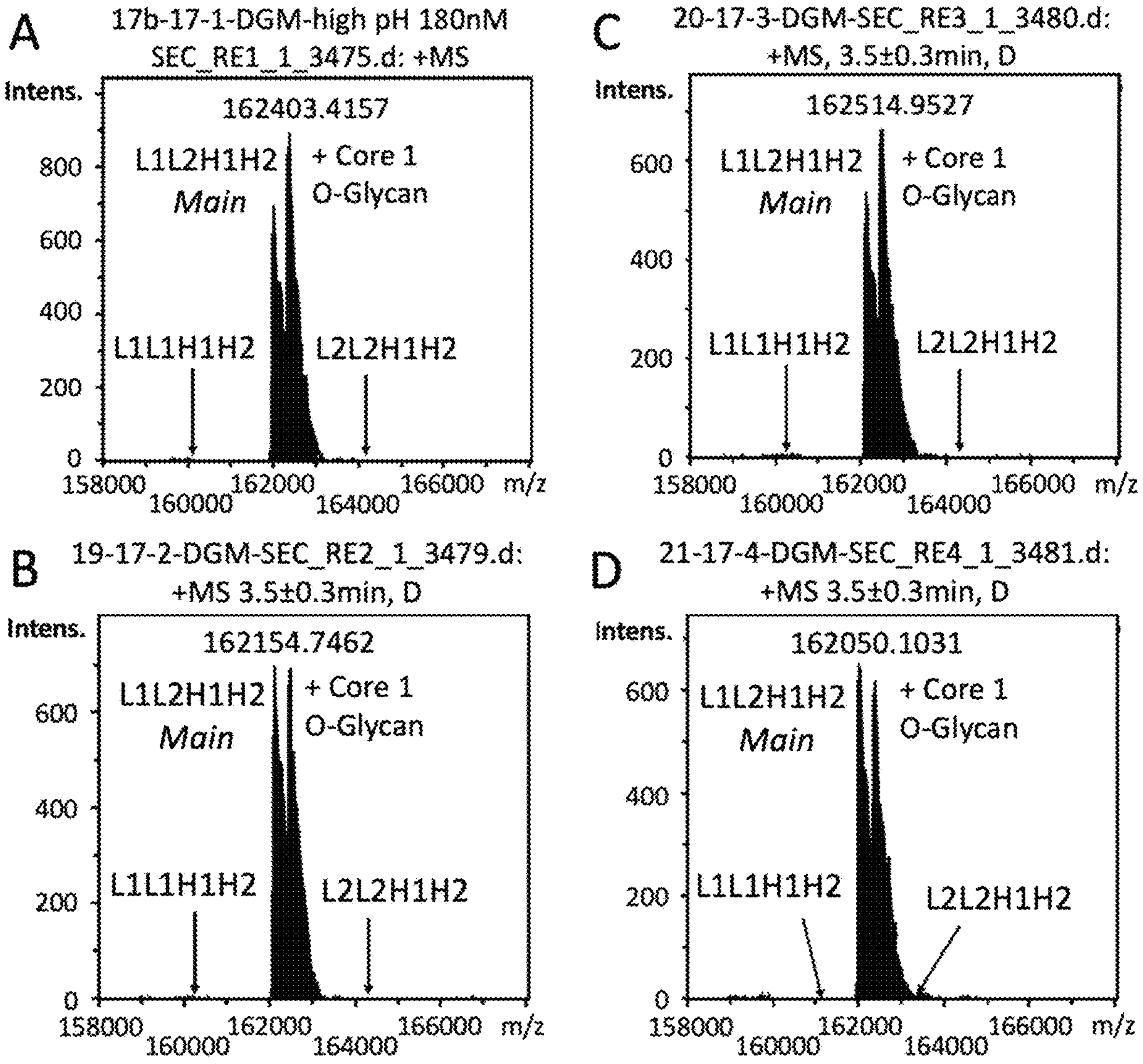
FIG. 50A-FIG. 50C: Relative of quantitation of correct pairing and mispairing in bispecific antibodies. Main peak represents correctly paired molecules. Arrows point to positions at which one would expect mispaired products. The main peak consists of two peaks owing to residual O-glycan remaining after de-glycosylation procedure.
Figure 50B:
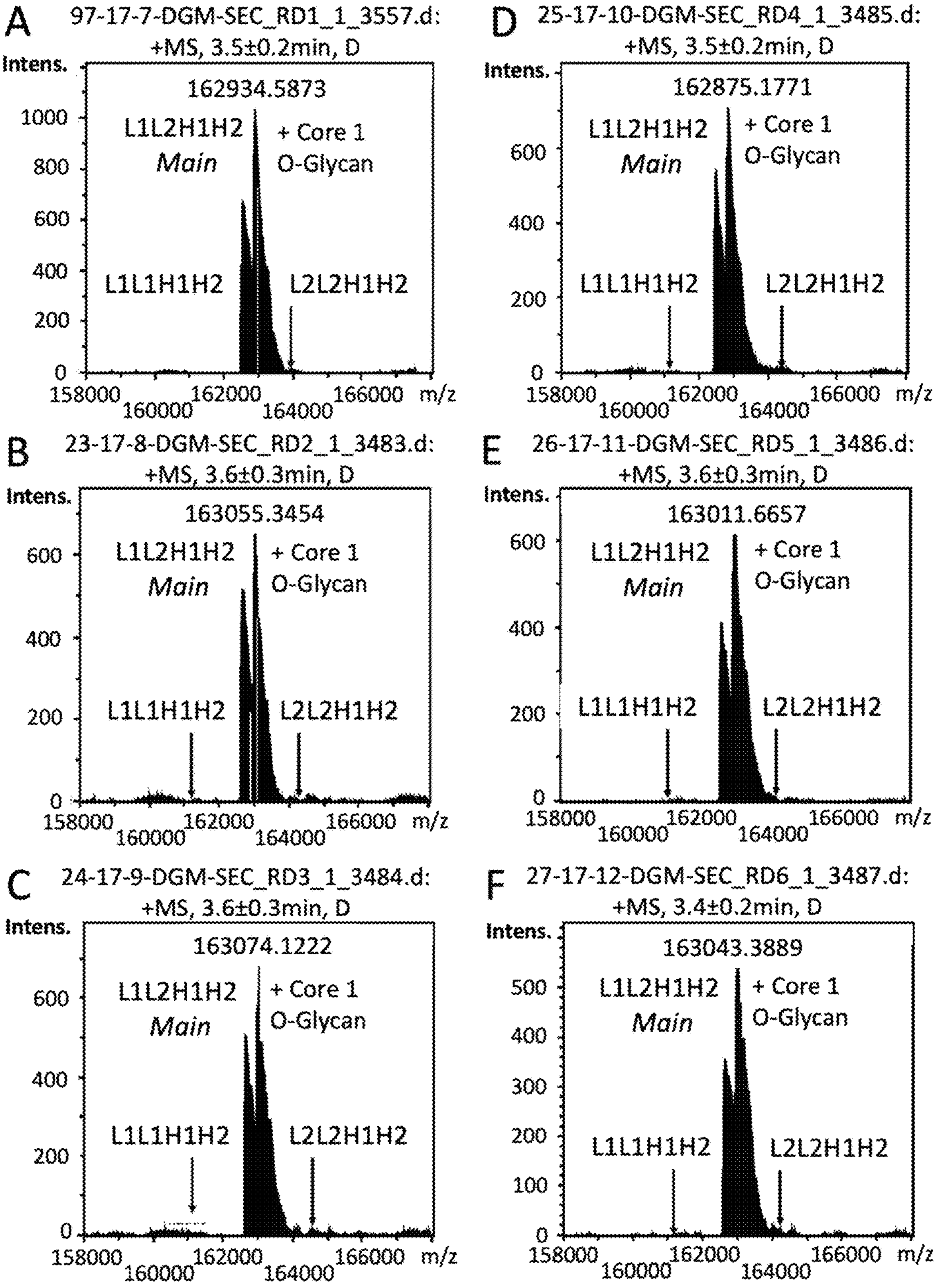
Figure 50C:
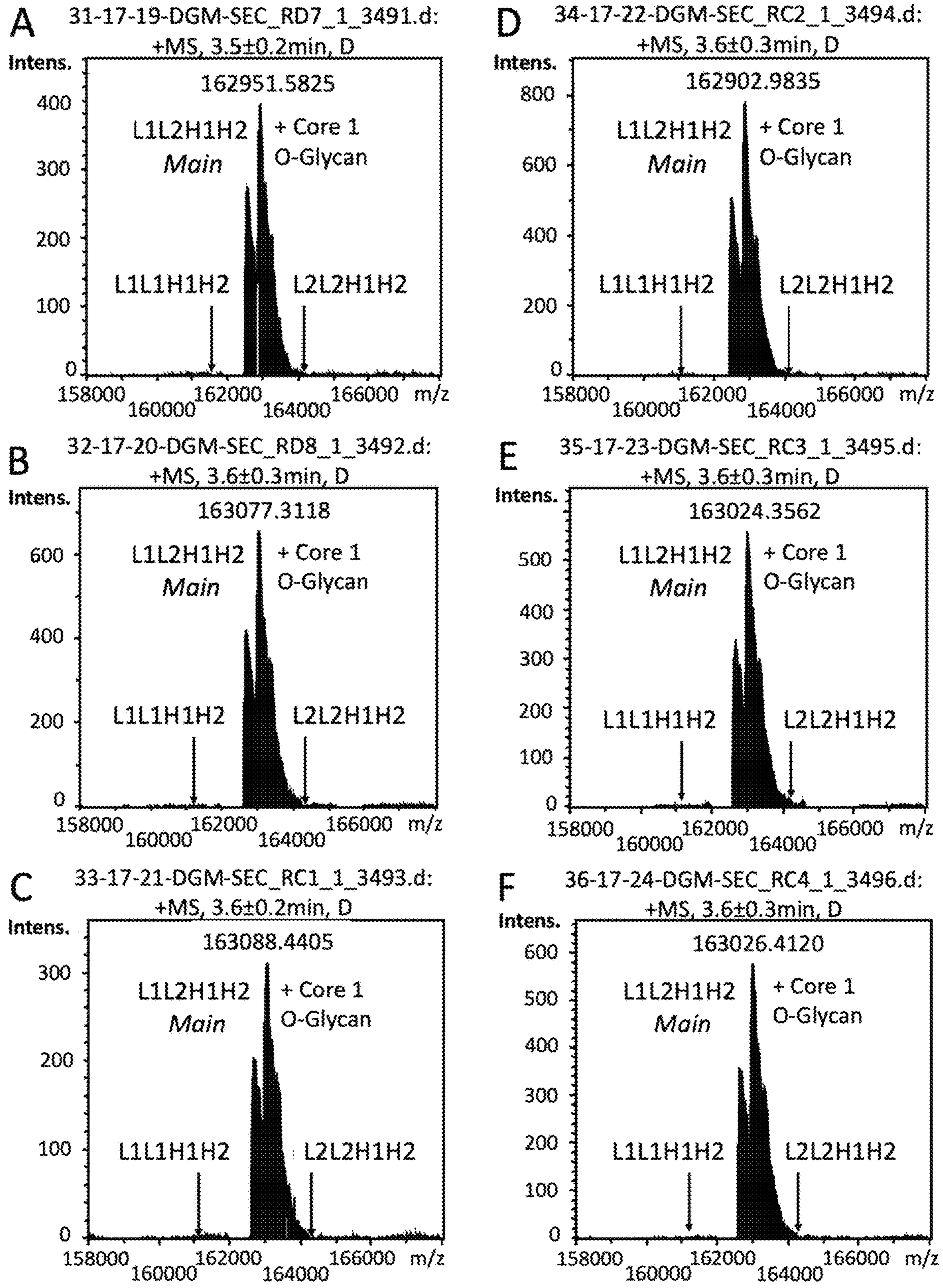

Following deconvolution, the intensity of the signal was determined for the correctly VH/VL paired tetrahedral antibody (L1L2H1H2) and the two mispaired side-products (L1L1H1H2, L2L2H1H2). Results were obtained for 16 of the constructs (FIG. 50A-50C). No significant mispairing was detected for the H1/H2 chains. The percentage of the main product and side products was calculated and normalized to the total yield of the correct and incorrect products (Table 39). The yield of the correctly paired VH/VL construct (L1L2H1H2) ranged from 98.0 to 99.7%; the yield of the correctly paired VH/VL for four of the constructs was greater than 99.5%.

TABLE 36

| Protein ID | L1 Chain | H1 Chain | L2 Chain | H2 Chain |
|---|---|---|---|---|
| 17-01 | SEQ ID NO: 576 | SEQ ID NO: 556 | SEQ ID NO: 577 | SEQ ID NO: 557 |
| 17-02 | SEQ ID NO: 578 | SEQ ID NO: 558 | SEQ ID NO: 579 | SEQ ID NO: 559 |
| 17-03 | SEQ ID NO: 578 | SEQ ID NO: 558 | SEQ ID NO: 580 | SEQ ID NO: 560 |
| 17-04 | SEQ ID NO: 581 | SEQ ID NO: 561 | SEQ ID NO: 582 | SEQ ID NO: 562 |
| 17-05 | SEQ ID NO: 583 | SEQ ID NO: 563 | SEQ ID NO: 584 | SEQ ID NO: 564 |
| 17-06 | SEQ ID NO: 583 | SEQ ID NO: 563 | SEQ ID NO: 585 | SEQ ID NO: 565 |
| 17-07 | SEQ ID NO: 586 | SEQ ID NO: 556 | SEQ ID NO: 577 | SEQ ID NO: 557 |
| 17-08 | SEQ ID NO: 587 | SEQ ID NO: 558 | SEQ ID NO: 579 | SEQ ID NO: 559 |
| 17-09 | SEQ ID NO: 587 | SEQ ID NO: 558 | SEQ ID NO: 580 | SEQ ID NO: 560 |
| 17-10 | SEQ ID NO: 581 | SEQ ID NO: 561 | SEQ ID NO: 588 | SEQ ID NO: 562 |
| 17-11 | SEQ ID NO: 583 | SEQ ID NO: 563 | SEQ ID NO: 589 | SEQ ID NO: 564 |
| 17-12 | SEQ ID NO: 583 | SEQ ID NO: 563 | SEQ ID NO: 590 | SEQ ID NO: 565 |
| 17-13 | SEQ ID NO: 576 | SEQ ID NO: 566 | SEQ ID NO: 577 | SEQ ID NO: 567 |
| 17-14 | SEQ ID NO: 578 | SEQ ID NO: 568 | SEQ ID NO: 579 | SEQ ID NO: 569 |
| 17-15 | SEQ ID NO: 578 | SEQ ID NO: 568 | SEQ ID NO: 580 | SEQ ID NO: 570 |
| 17-16 | SEQ ID NO: 581 | SEQ ID NO: 571 | SEQ ID NO: 582 | SEQ ID NO: 572 |
| 17-17 | SEQ ID NO: 583 | SEQ ID NO: 573 | SEQ ID NO: 584 | SEQ ID NO: 574 |
| 17-18 | SEQ ID NO: 583 | SEQ ID NO: 573 | SEQ ID NO: 585 | SEQ ID NO: 575 |
| 17-19 | SEQ ID NO: 586 | SEQ ID NO: 566 | SEQ ID NO: 577 | SEQ ID NO: 567 |
| 17-20 | SEQ ID NO: 587 | SEQ ID NO: 568 | SEQ ID NO: 579 | SEQ ID NO: 569 |
| 17-21 | SEQ ID NO: 587 | SEQ ID NO: 568 | SEQ ID NO: 580 | SEQ ID NO: 570 |
| 17-22 | SEQ ID NO: 581 | SEQ ID NO: 571 | SEQ ID NO: 588 | SEQ ID NO: 572 |
| 17-23 | SEQ ID NO: 583 | SEQ ID NO: 573 | SEQ ID NO: 589 | SEQ ID NO: 574 |
| 17-24 | SEQ ID NO: 583 | SEQ ID NO: 573 | SEQ ID NO: 590 | SEQ ID NO: 575 |
| 17-25 | SEQ ID NO: 631 | SEQ ID NO: 591 | SEQ ID NO: 632 | SEQ ID NO: 592 |
| 17-26 | SEQ ID NO: 633 | SEQ ID NO: 593 | SEQ ID NO: 634 | SEQ ID NO: 594 |
| 17-27 | SEQ ID NO: 633 | SEQ ID NO: 593 | SEQ ID NO: 635 | SEQ ID NO: 595 |
| 17-28 | SEQ ID NO: 631 | SEQ ID NO: 596 | SEQ ID NO: 632 | SEQ ID NO: 597 |
| 17-29 | SEQ ID NO: 633 | SEQ ID NO: 598 | SEQ ID NO: 634 | SEQ ID NO: 599 |
| 17-30 | SEQ ID NO: 633 | SEQ ID NO: 598 | SEQ ID NO: 635 | SEQ ID NO: 600 |
| 17-31 | SEQ ID NO: 636 | SEQ ID NO: 601 | SEQ ID NO: 637 | SEQ ID NO: 602 |
| 17-32 | SEQ ID NO: 638 | SEQ ID NO: 603 | SEQ ID NO: 639 | SEQ ID NO: 604 |
| 17-33 | SEQ ID NO: 638 | SEQ ID NO: 603 | SEQ ID NO: 640 | SEQ ID NO: 605 |
| 17-34 | SEQ ID NO: 636 | SEQ ID NO: 606 | SEQ ID NO: 637 | SEQ ID NO: 607 |
| 17-35 | SEQ ID NO: 638 | SEQ ID NO: 608 | SEQ ID NO: 639 | SEQ ID NO: 609 |
| 17-36 | SEQ ID NO: 638 | SEQ ID NO: 608 | SEQ ID NO: 640 | SEQ ID NO: 610 |
| 17-37 | SEQ ID NO: 631 | SEQ ID NO: 611 | SEQ ID NO: 632 | SEQ ID NO: 612 |
| 17-38 | SEQ ID NO: 633 | SEQ ID NO: 613 | SEQ ID NO: 634 | SEQ ID NO: 614 |
| 17-39 | SEQ ID NO: 633 | SEQ ID NO: 613 | SEQ ID NO: 635 | SEQ ID NO: 615 |
| 17-40 | SEQ ID NO: 631 | SEQ ID NO: 616 | SEQ ID NO: 632 | SEQ ID NO: 617 |
| 17-41 | SEQ ID NO: 633 | SEQ ID NO: 618 | SEQ ID NO: 634 | SEQ ID NO: 619 |
| 17-42 | SEQ ID NO: 633 | SEQ ID NO: 618 | SEQ ID NO: 635 | SEQ ID NO: 620 |
| 17-43 | SEQ ID NO: 636 | SEQ ID NO: 621 | SEQ ID NO: 637 | SEQ ID NO: 622 |
| 17-44 | SEQ ID NO: 638 | SEQ ID NO: 623 | SEQ ID NO: 639 | SEQ ID NO: 624 |
| 17-45 | SEQ ID NO: 638 | SEQ ID NO: 623 | SEQ ID NO: 640 | SEQ ID NO: 625 |
| 17-46 | SEQ ID NO: 636 | SEQ ID NO: 626 | SEQ ID NO: 637 | SEQ ID NO: 627 |
| 17-47 | SEQ ID NO: 638 | SEQ ID NO: 628 | SEQ ID NO: 639 | SEQ ID NO: 629 |
| 17-48 | SEQ ID NO: 638 | SEQ ID NO: 628 | SEQ ID NO: 640 | SEQ ID NO: 630 |

TABLE 37

| | D1-Fc | | | | | | | D2-Fc | | |
|---|---|---|---|---|---|---|---|---|---|---|
| Protein ID | FcRn | H1 | H2 | D5-Fab | D4-Fab | D3-Fab | D6-Fab | FcRn | H1 | H2 |
| 17-01 | DHS | RF | HY | REGN10933 | REGN10987 | REGN10987 | REGN10933 | DHS | RF | HY |
| 17-02 | DHS | RF | HY | REGN10933 | REGN10987 | REGN10987 | REGN10933 | DHS | RF | HY |

TABLE 37-continued

| | D1-Fc | | | | | | | D2-Fc | | |
|---|---|---|---|---|---|---|---|---|---|---|
| Protein ID | FcRn | H1 | H2 | D5-Fab | D4-Fab | D3-Fab | D6-Fab | FcRn | H1 | H2 |
| 17-03 | DHS | RF | HY | REGN10933 | REGN10987 | REGN10987 | REGN10933 | DHS | RF | HY |
| 17-04 | DHS | RF | HY | REGN10987 | REGN10933 | REGN10933 | REGN10987 | DHS | RF | HY |
| 17-05 | DHS | RF | HY | REGN10987 | REGN10933 | REGN10933 | REGN10987 | DHS | RF | HY |
| 17-06 | DHS | RF | HY | REGN10987 | REGN10933 | REGN10933 | REGN10987 | DHS | RF | HY |
| 17-07 | DHS | RF | HY | REGN10933 | REGN10987 | REGN10987 | REGN10933 | DHS | RF | HY |
| 17-08 | DHS | RF | HY | REGN10933 | REGN10987 | REGN10987 | REGN10933 | DHS | RF | HY |
| 17-09 | DHS | RF | HY | REGN10933 | REGN10987 | REGN10987 | REGN10933 | DHS | RF | HY |
| 17-10 | DHS | RF | HY | REGN10987 | REGN10933 | REGN10933 | REGN10987 | DHS | RF | HY |
| 17-11 | DHS | RF | HY | REGN10987 | REGN10933 | REGN10933 | REGN10987 | DHS | RF | HY |
| 17-12 | DHS | RF | HY | REGN10987 | REGN10933 | REGN10933 | REGN10987 | DHS | RF | HY |
| 17-13 | DHS | HY | RF | REGN10933 | REGN10987 | REGN10987 | REGN10933 | DHS | HY | RF |
| 17-14 | DHS | HY | RF | REGN10933 | REGN10987 | REGN10987 | REGN10933 | DHS | HY | RF |
| 17-15 | DHS | HY | RF | REGN10933 | REGN10987 | REGN10987 | REGN10933 | DHS | HY | RF |
| 17-16 | DHS | HY | RF | REGN10987 | REGN10933 | REGN10933 | REGN10987 | DHS | HY | RF |
| 17-17 | DHS | HY | RF | REGN10987 | REGN10933 | REGN10933 | REGN10987 | DHS | HY | RF |
| 17-18 | DHS | HY | RF | REGN10987 | REGN10933 | REGN10933 | REGN10987 | DHS | HY | RF |
| 17-19 | DHS | HY | RF | REGN10933 | REGN10987 | REGN10987 | REGN10933 | DHS | HY | RF |
| 17-20 | DHS | HY | RF | REGN10933 | REGN10987 | REGN10987 | REGN10933 | DHS | HY | RF |
| 17-21 | DHS | HY | RF | REGN10933 | REGN10987 | REGN10987 | REGN10933 | DHS | HY | RF |
| 17-22 | DHS | HY | RF | REGN10987 | REGN10933 | REGN10933 | REGN10987 | DHS | HY | RF |
| 17-23 | DHS | HY | RF | REGN10987 | REGN10933 | REGN10933 | REGN10987 | DHS | HY | RF |
| 17-24 | DHS | HY | RF | REGN10987 | REGN10933 | REGN10933 | REGN10987 | DHS | HY | RF |
| 17-25 | wt | RF | HY | O24A | B13A | B13A | O24A | wt | RF | HY |
| 17-26 | wt | RF | HY | O24A | B13A | B13A | O24A | wt | RF | HY |
| 17-27 | wt | RF | HY | O24A | B13A | B13A | O24A | wt | RF | HY |
| 17-28 | DHS | RF | HY | O24A | B13A | B13A | O24A | DHS | RF | HY |
| 17-29 | DHS | RF | HY | O24A | B13A | B13A | O24A | DHS | RF | HY |
| 17-30 | DHS | RF | HY | O24A | B13A | B13A | O24A | DHS | RF | HY |
| 17-31 | wt | RF | HY | B13A | O24A | O24A | B13A | wt | RF | HY |
| 17-32 | wt | RF | HY | B13A | O24A | O24A | B13A | wt | RF | HY |
| 17-33 | wt | RF | HY | B13A | O24A | O24A | B13A | wt | RF | HY |
| 17-34 | DHS | RF | HY | B13A | O24A | O24A | B13A | DHS | RF | HY |
| 17-35 | DHS | RF | HY | B13A | O24A | O24A | B13A | DHS | RF | HY |
| 17-36 | DHS | RF | HY | B13A | O24A | O24A | B13A | DHS | RF | HY |
| 17-37 | wt | HY | RF | O24A | B13A | B13A | O24A | wt | HY | RF |
| 17-38 | wt | HY | RF | O24A | B13A | B13A | O24A | wt | HY | RF |
| 17-39 | wt | HY | RF | O24A | B13A | B13A | O24A | wt | HY | RF |
| 17-40 | DHS | HY | RF | O24A | B13A | B13A | O24A | DHS | HY | RF |
| 17-41 | DHS | HY | RF | O24A | B13A | B13A | O24A | DHS | HY | RF |
| 17-42 | DHS | HY | RF | O24A | B13A | B13A | O24A | DHS | HY | RF |
| 17-43 | wt | HY | RF | B13A | O24A | O24A | B13A | wt | HY | RF |
| 17-44 | wt | HY | RF | B13A | O24A | O24A | B13A | wt | HY | RF |
| 17-45 | wt | HY | RF | B13A | O24A | O24A | B13A | wt | HY | RF |
| 17-46 | DHS | HY | RF | B13A | O24A | O24A | B13A | DHS | HY | RF |
| 17-47 | DHS | HY | RF | B13A | O24A | O24A | B13A | DHS | HY | RF |
| 17-48 | DHS | HY | RF | B13A | O24A | O24A | B13A | DHS | HY | RF |

TABLE 38

| | L1 Chain | | H1 Chain | | L2 Chain | | H2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 17-01 | VL-CL | E123R/Q124K | VH-CH1 | K147E/K213E | VH-CK | | VK-CH1 | |
| 17-02 | VL-CL | Q38E/V133K | VH-CH1 | Q39K/S183E | VH-CK | Q39K/V133E | VK-CH1 | Q38E/S183K |
| 17-03 | VL-CL | Q38E/V133K | VH-CH1 | Q39K/S183E | VH-CK | Q39E/V133E | VK-CH1 | Q38K/S183K |
| 17-04 | VK-CK | E123R/Q124K | VH-CH1 | K147E/K213E | VH-CL | | VL-CH1 | |
| 17-05 | VK-CK | Q38E/V133K | VH-CH1 | Q39K/S183E | VH-CL | Q39K/V133E | VL-CH1 | Q38E/S183K |
| 17-06 | VK-CK | Q38E/V133K | VH-CH1 | Q39K/S183E | VH-CL | Q39E/V133E | VL-CH1 | Q38K/S183K |
| 17-07 | VL-CK | E123R/Q124K | VH-CH1 | K147E/K213E | VH-CK | | VK-CH1 | |
| 17-08 | VL-CK | Q38E/V133K | VH-CH1 | Q39K/S183E | VH-CK | Q39K/V133E | VK-CH1 | Q38E/S183K |
| 17-09 | VL-CK | Q38E/V133K | VH-CH1 | Q39K/S183E | VH-CK | Q39E/V133E | VK-CH1 | Q38K/S183K |
| 17-10 | VK-CK | E123R/Q124K | VH-CH1 | K147E/K213E | VH-CK | | VL-CH1 | |
| 17-11 | VK-CK | Q38E/V133K | VH-CH1 | Q39K/S183E | VH-CK | Q39K/V133E | VL-CH1 | Q38E/S183K |
| 17-12 | VK-CK | Q38E/V133K | VH-CH1 | Q39K/S183E | VH-CK | Q39E/V133E | VL-CH1 | Q38K/S183K |
| 17-13 | VL-CL | E123R/Q124K | VH-CH1 | K147E/K213E | VH-CK | | VK-CH1 | |
| 17-14 | VL-CL | Q38E/V133K | VH-CH1 | Q39K/S183E | VH-CK | Q39K/V133E | VK-CH1 | Q38E/S183K |
| 17-15 | VL-CL | Q38E/V133K | VH-CH1 | Q39K/S183E | VH-CK | Q39E/V133E | VK-CH1 | Q38K/S183K |
| 17-16 | VK-CK | E123R/Q124K | VH-CH1 | K147E/K213E | VH-CL | | VL-CH1 | |
| 17-17 | VK-CK | Q38E/V133K | VH-CH1 | Q39K/S183E | VH-CL | Q39K/V133E | VL-CH1 | Q38E/S183K |
| 17-18 | VK-CK | Q38E/V133K | VH-CH1 | Q39K/S183E | VH-CL | Q39E/V133E | VL-CH1 | Q38K/S183K |
| 17-19 | VL-CK | E123R/Q124K | VH-CH1 | K147E/K213E | VH-CK | | VK-CH1 | |

TABLE 38-continued

| | L1 Chain | | H1 Chain | | L2 Chain | | H2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 17-20 | VL-CK | Q38E/V133K | VH-CH1 | Q39K/S183E | VH-CK | Q39K/V133E | VK-CH1 | Q38E/S183K |
| 17-21 | VL-CK | Q38E/V133K | VH-CH1 | Q39K/S183E | VH-CK | Q39E/V133E | VK-CH1 | Q38K/S183K |
| 17-22 | VK-CK | E123R/Q124K | VH-CH1 | K147E/K213E | VH-CK | | VL-CH1 | |
| 17-23 | VK-CK | Q38E/V133K | VH-CH1 | Q39K/S183E | VH-CK | Q39K/V133E | VL-CH1 | Q38E/S183K |
| 17-24 | VK-CK | Q38E/V133K | VH-CH1 | Q39K/S183E | VH-CK | Q39E/V133E | VL-CH1 | Q38K/S183K |
| 17-25 | VK-CK | E123R/Q124K | VH-CH1 | K147E/K213E | VH-CK | | VK-CH1 | |
| 17-26 | VK-CK | Q38E/V133K | VH-CH1 | Q39K/S183E | VH-CK | Q39K/V133E | VK-CH1 | Q38E/S183K |
| 17-27 | VK-CK | Q38E/V133K | VH-CH1 | Q39K/S183E | VH-CK | Q39E/V133E | VK-CH1 | Q38K/S183K |
| 17-28 | VK-CK | E123R/Q124K | VH-CH1 | K147E/K213E | VH-CK | | VK-CH1 | |
| 17-29 | VK-CK | Q38E/V133K | VH-CH1 | Q39K/S183E | VH-CK | Q39K/V133E | VK-CH1 | Q38E/S183K |
| 17-30 | VK-CK | Q38E/V133K | VH-CH1 | Q39K/S183E | VH-CK | Q39E/V133E | VK-CH1 | Q38K/S183K |
| 17-31 | VK-CK | E123R/Q124K | VH-CH1 | K147E/K213E | VH-CK | | VK-CH1 | |
| 17-32 | VK-CK | Q38E/V133K | VH-CH1 | Q39K/S183E | VH-CK | Q39K/V133E | VK-CH1 | Q38E/S183K |
| 17-33 | VK-CK | Q38E/V133K | VH-CH1 | Q39K/S183E | VH-CK | Q39E/V133E | VK-CH1 | Q38K/S183K |
| 17-34 | VK-CK | E123R/Q124K | VH-CH1 | K147E/K213E | VH-CK | | VK-CH1 | |
| 17-35 | VK-CK | Q38E/V133K | VH-CH1 | Q39K/S183E | VH-CK | Q39K/V133E | VK-CH1 | Q38E/S183K |
| 17-36 | VK-CK | Q38E/V133K | VH-CH1 | Q39K/S183E | VH-CK | Q39E/V133E | VK-CH1 | Q38K/S183K |
| 17-37 | VK-CK | E123R/Q124K | VH-CH1 | K147E/K213E | VH-CK | | VK-CH1 | |
| 17-38 | VK-CK | Q38E/V133K | VH-CH1 | Q39K/S183E | VH-CK | Q39K/V133E | VK-CH1 | Q38E/S183K |
| 17-39 | VK-CK | Q38E/V133K | VH-CH1 | Q39K/S183E | VH-CK | Q39E/V133E | VK-CH1 | Q38K/S183K |
| 17-40 | VK-CK | E123R/Q124K | VH-CH1 | K147E/K213E | VH-CK | | VK-CH1 | |
| 17-41 | VK-CK | Q38E/V133K | VH-CH1 | Q39K/S183E | VH-CK | Q39K/V133E | VK-CH1 | Q38E/S183K |
| 17-42 | VK-CK | Q38E/V133K | VH-CH1 | Q39K/S183E | VH-CK | Q39E/V133E | VK-CH1 | Q38K/S183K |
| 17-43 | VK-CK | E123R/Q124K | VH-CH1 | K147E/K213E | VH-CK | | VK-CH1 | |
| 17-44 | VK-CK | Q38E/V133K | VH-CH1 | Q39K/S183E | VH-CK | Q39K/V133E | VK-CH1 | Q38E/S183K |
| 17-45 | VK-CK | Q38E/V133K | VH-CH1 | Q39K/S183E | VH-CK | Q39E/V133E | VK-CH1 | Q38K/S183K |
| 17-46 | VK-CK | E123R/Q124K | VH-CH1 | K147E/K213E | VH-CK | | VK-CH1 | |
| 17-47 | VK-CK | Q38E/V133K | VH-CH1 | Q39K/S183E | VH-CK | Q39K/V133E | VK-CH1 | Q38E/S183K |
| 17-48 | VK-CK | Q38E/V133K | VH-CH1 | Q39K/S183E | VH-CK | Q39E/V133E | VK-CH1 | Q38K/S183K |

TABLE 39

| Protein | L1L1H1H2 | L1L2H1H2 | L2L2H1H2 | | Theoretical Average Intact Mass, Da | | |
|---|---|---|---|---|---|---|---|
| ID | (%) | (%) | (%) | Delta, Da | L1L1H1H2 | L1L2H1H2 | L2L2H1H2 |
| 17-01 | 0.2 | 99.7 | 0.1 | 2027 | 160023 | 162050 | 164077 |
| 17-02 | 0.4 | 99.6 | 0.0 | 2053 | 160113 | 162166 | 164220 |
| 17-03 | 0.8 | 99.2 | 0.0 | 2054 | 160112 | 162166 | 164221 |
| 17-04 | 0.0 | 98.0 | 2.0 | 1021 | 161042 | 162063 | 163084 |
| 17-07 | 0.0 | 99.6 | 0.4 | 1498 | 161082 | 162580 | 164077 |
| 17-08 | 0.3 | 98.6 | 1.1 | 1525 | 161170 | 162695 | 163220 |
| 17-09 | 0.9 | 98.4 | 0.7 | 1526 | 161169 | 162695 | 164221 |
| 17-10 | 0.3 | 98.6 | 1.1 | 1481 | 161042 | 162523 | 164003 |
| 17-11 | 0.3 | 99.1 | 0.5 | 1535 | 161130 | 162665 | 164200 |
| 17-12 | 0.3 | 98.9 | 0.8 | 1536 | 161129 | 162655 | 164200 |
| 17-19 | 0.5 | 99.2 | 0.3 | 1498 | 161082 | 162580 | 164077 |
| 17-20 | 0.2 | 99.3 | 0.5 | 1525 | 161170 | 162695 | 164220 |
| 17-21 | 0.3 | 99.5 | 0.2 | 1526 | 161169 | 162695 | 164221 |
| 17-22 | 0.4 | 99.0 | 0.6 | 1481 | 161042 | 162523 | 164003 |
| 17-23 | 0.3 | 98.5 | 1.2 | 1535 | 161130 | 162665 | 164200 |
| 17-24 | 0.4 | 98.9 | 0.7 | 1536 | 161129 | 162665 | 164200 |

Example 19—Neutralization of SARS-CoV-2 Pseudovirus by Bispecific Tetrahedral Antibodies The tetrahedral antibody constructs of Example 18 were evaluated for their functional bispecificity using a SARS-CoV-2 pseudovirus neutralization assay (Integral Molecular, Philadelphia, PA) as described in Example 18. Each construct was evaluated against two SARS-CoV-2 variants: an N439L variant highly resistant to REGN10987 (genotype N439K, D614G; Catalog #RVP-703) and a South African Δ3 B.1.351 variant highly resistant to REGN10933 (genotype L18F, D80A, D215G, AL242/L243/L244, R246I, K417N, N501Y, E484K, A701V; Catalog #RVP-724). The activity each of the bispecific constructs was directly compared with the parent antibodies REGN10987 and REN10933 as well as REGN-CoV-2, a 1:1 cocktail of REGN10987 and REGN10933. The biosimilar versions of REGN10987, REGN10933 and REGN-CoV-2 used in this study were produced at Lakepharma Inc. (Belmont, CA).

Figure 51A:
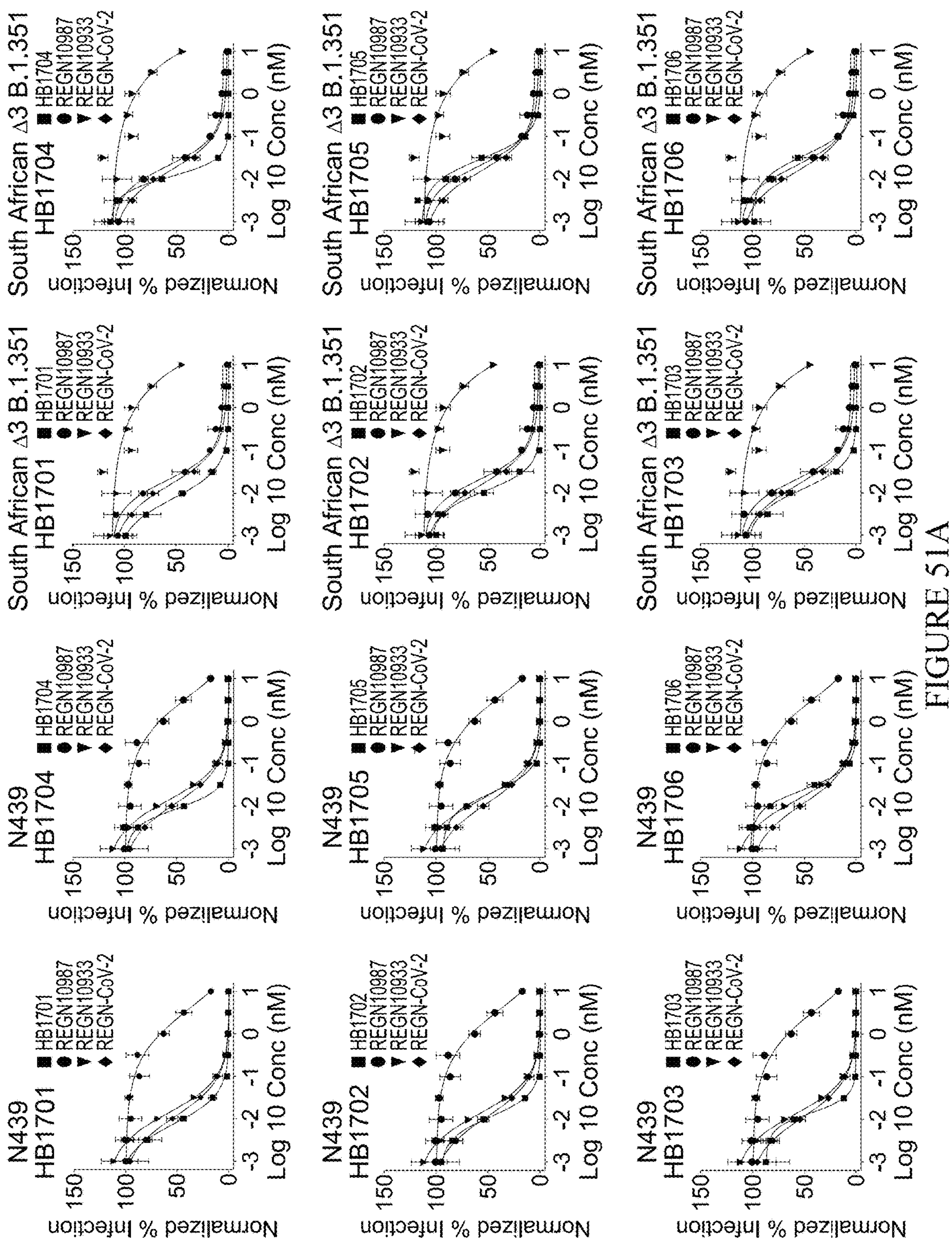
FIG. 51A-FIG. 51C: Relative neutralization activity of various antibodies against N439K and South African variants. ACE2 superheterodimers (squares) are described in Tables 36, 37, and 38.
Figure 51B:
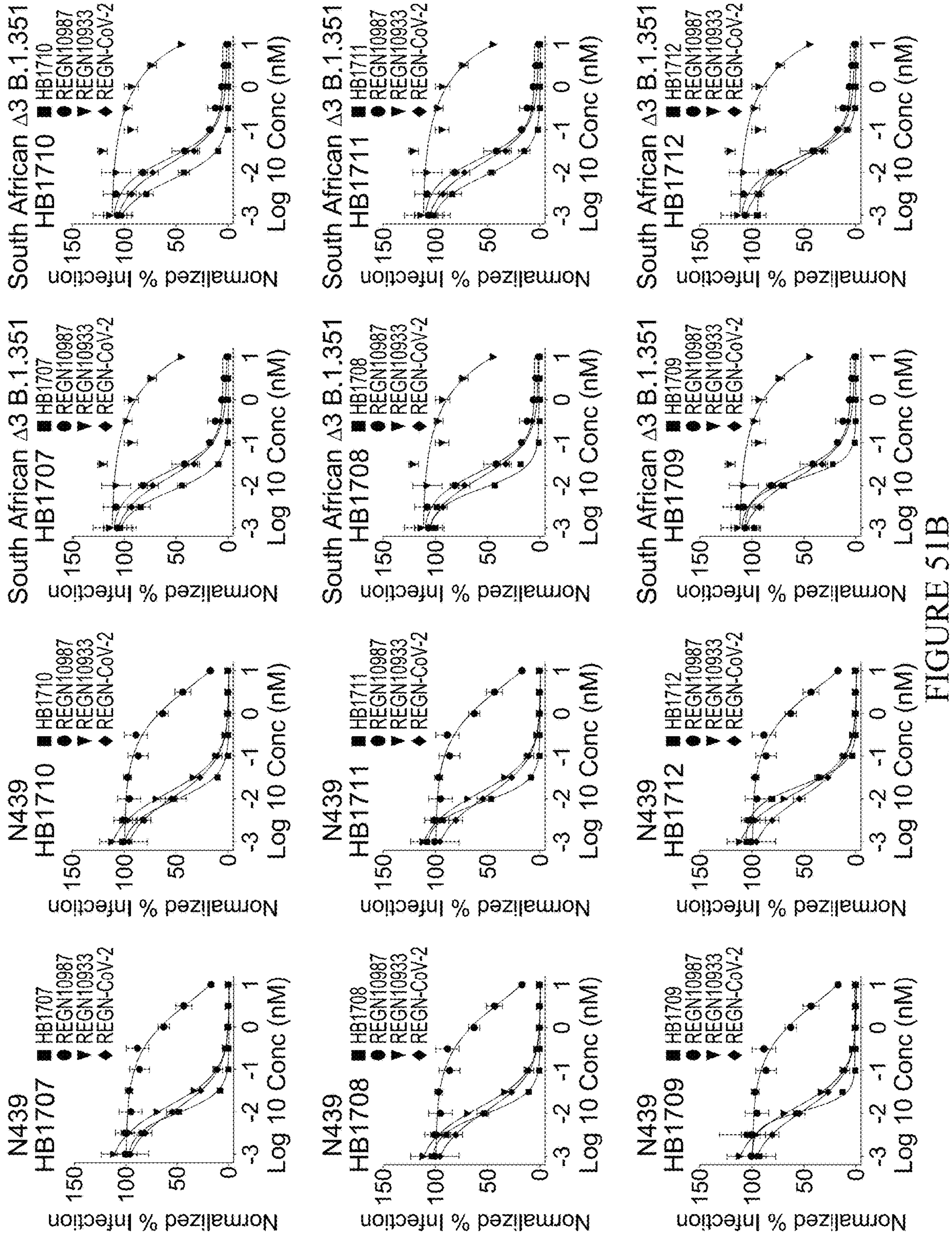
Figure 51C:
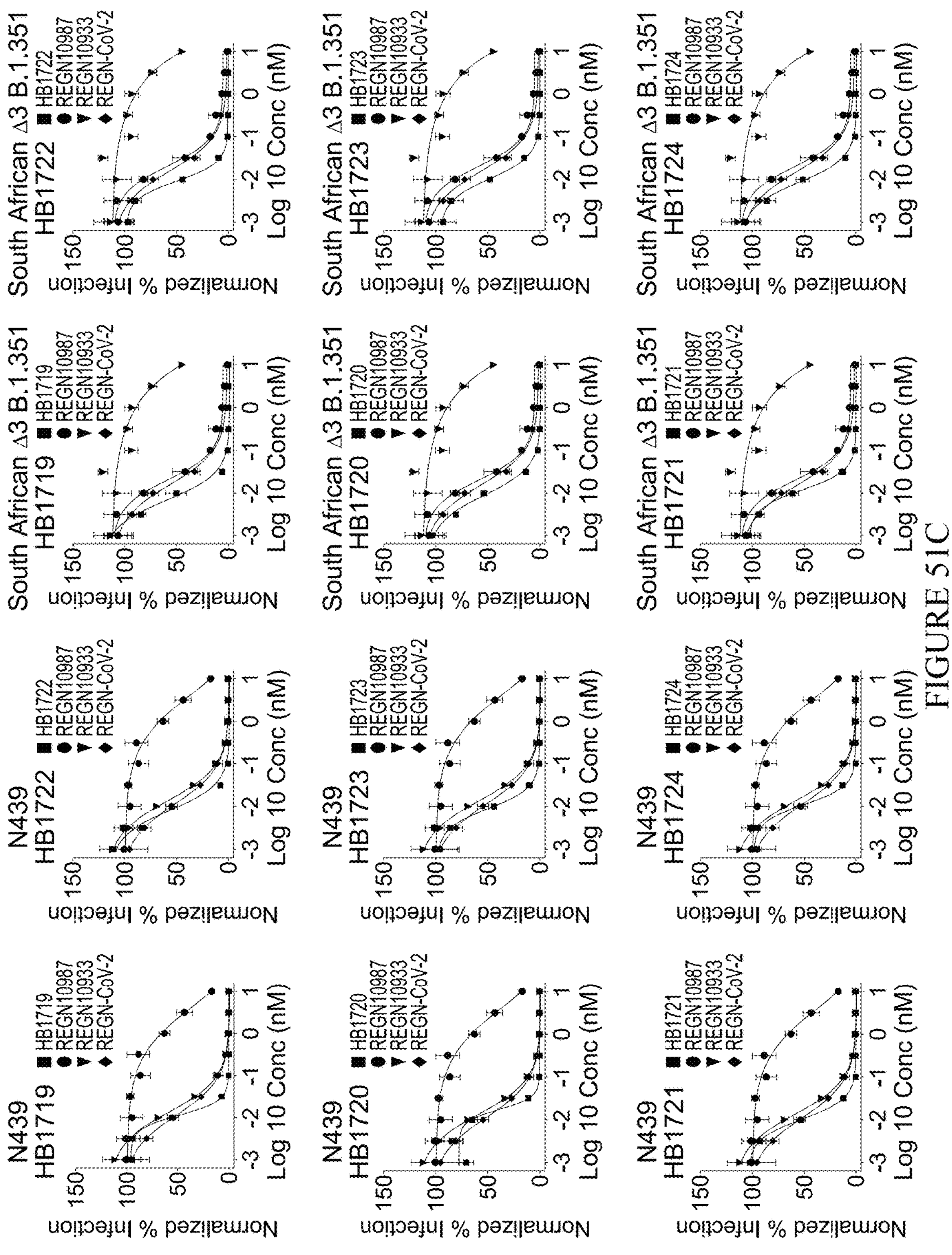

Results were obtained for 18 of the constructs (FIG. 51A-51C, Table 40). With respect to the control constructs, REGN10987 was approximately 1,000-fold less potent than REGN10933 against the N439K variant, and REGN10933 was approximately 3,000-fold less potent than REGN10987 against the South African variant. The REGN-CoV-2 cocktail was approximately 1.5-fold more potent than REGN10933 against the N439 variant and approximately equal in potency to REGB10987 against the South African variant. All 18 of the tetravalent, bispecific tetrahedral antibody constructs potently neutralized both the N439K and South African variants; 15 of the 18 bispecific constructs were at least as potent as the REGN-CoV-2 cocktail against the N43K variant, and 14 of the 18 bispecific constructs were approximately two- to three-fold more potent than the REGN-CoV-2 cocktail against the South African variant.

TABLE 40

| | EC50 (pM) Neutralization | | | | | |
|---|---|---|---|---|---|---|
| Protein ID | N439K | South Africa B.1.351 | D5-Fab | D4-Fab | D3-Fab | D6-Fab |
| REGN10987 | 2,256.46 | 2.48 | | | | |
| REGN10987 | 2,216.82 | 2.37 | | | | |
| REGN10933 | 2.09 | 7,776.27 | | | | |
| REGN10933 | 1.80 | 8,548.99 | | | | |
| REGN-CoV2 | 1.18 | 1.87 | | | | |
| REGN-CoV2 | 1.44 | 2.91 | | | | |
| 17-01 | 1.10 | 0.82 | REGN10933 | REGN10987 | REGN10987 | REGN10933 |
| 17-02 | 1.08 | 1.19 | REGN10933 | REGN10987 | REGN10987 | REGN10933 |
| 17-03 | 1.25 | 1.29 | REGN10933 | REGN10987 | REGN10987 | REGN10933 |
| 17-04 | 0.87 | 1.25 | REGN10987 | REGN10933 | REGN10933 | REGN10987 |
| 17-05 | 1.88 | 3.88 | REGN10987 | REGN10933 | REGN10933 | REGN10987 |
| 17-06 | 2.51 | 5.81 | REGN10987 | REGN10933 | REGN10933 | REGN10987 |
| 17-07 | 0.92 | 0.84 | REGN10933 | REGN10987 | REGN10987 | REGN10933 |
| 17-08 | 1.03 | 0.97 | REGN10933 | REGN10987 | REGN10987 | REGN10933 |
| 17-09 | 1.16 | 1.59 | REGN10933 | REGN10987 | REGN10987 | REGN10933 |
| 17-10 | 0.96 | 0.75 | REGN10987 | REGN10933 | REGN10933 | REGN10987 |
| 17-11 | 0.92 | 0.90 | REGN10987 | REGN10933 | REGN10933 | REGN10987 |
| 17-12 | 2.22 | 2.53 | REGN10987 | REGN10933 | REGN10933 | REGN10987 |
| 17-19 | 1.11 | 0.86 | REGN10933 | REGN10987 | REGN10987 | REGN10933 |
| 17-20 | 1.43 | 0.98 | REGN10933 | REGN10987 | REGN10987 | REGN10933 |
| 17-21 | 1.07 | 1.24 | REGN10933 | REGN10987 | REGN10987 | REGN10933 |
| 17-22 | 0.94 | 0.90 | REGN10987 | REGN10933 | REGN10933 | REGN10987 |
| 17-23 | 0.88 | 0.98 | REGN10987 | REGN10933 | REGN10933 | REGN10987 |
| 17-24 | 1.11 | 0.96 | REGN10987 | REGN10933 | REGN10933 | REGN10987 |

Example 20—Tetravalent, Bispecific Tetrahedral Antibodies Comprising Two Distinct Fabs that Specifically Bind CD38, BCMA, CD16 or CD3

The exceptional activity of tetravalent, bispecific tetrahedral antibodies against SARS-CoV-2 suggests their broad applicability in other fields such as cancer in which there is intense interest among investigators in the potential of multispecific targeting agents. Accordingly, three series of constructs were generated with the predicted structures shown in panel D of FIG. 31, panel C of FIG. 32, and panel D of FIG. 34, then evaluated for their bispecificity.

The first series of constructs employed VH and VL regions from daratumumab (Da), an FDA-approved anti-CD38 antibody used to target and treat multiple myeloma (SEQ ID Nos 641, 686), HA9, an anti-CD16 antibody that specifically targets and engages Natural Killer (NK) cells (SEQ ID Nos 648, 688), and SP34, an anti-CD3 antibody that specifically targets and engages T cells (SEQ ID Nos 657, 697). The second series of constructs additionally employed VH and VL regions from 4C8, an anti-BCMA antibody that targets myeloma cells and certain other cell types (SEQ ID Nos 663, 700). The third series of constructs additionally employed VH and VL regions from B34, an anti-BCMA antibody that targets myeloma cells and certain other cell types (SEQ ID Nos 676, 703) (Tables 41, 42, 43)

To optimize correct VH/VL pairing and to minimize VH/VL mispairing, V region exchange was combined with electrostatic steering as described in Example 18 (Table 44). Additionally, to further facilitate purification of the correctly paired product by Protein A chromatography, in some constructs, particularly those having the predicted structures shown in FIG. 31, Panel D and FIG. 32 Panel C, the H1 chain incorporated the H435R/Y436F substitution while the H2 chain had the H435/Y436 wild-type sequence. In other constructs, particularly those having the predicted structure shown in FIG. 34, Panel D, the H1 and H2 chains incorporated the H435R/Y436F substitution while the Fc chain had the H435/Y436 wild-type sequence (Table 42).

The constructs were evaluated for structural bispecificity by intact mass spectrometry, following removal of N-glycan and O-glycan, as described in Example 18. Results were obtained for 18 of the constructs (Table 45). No significant mispairing was detected for the H1/H2 chains. The percentage of the main product and side products was calculated and normalized to the total yield of the correct and incorrect products (Table 45). The yield of the correctly paired VH/VL construct (L1L2H1H2) ranged from 94.6 to 98.2% when daratumumab was combined with HA9, 94.3 to 97.7% when 4C8 was combined with HA9, and 96.8 to 99.5% when 4C8 was combined with daratumumab. For constructs 18-30, 18-31 and 18-32, two bispecific products were detected by LC/MS as expected for the predicted structure shown in FIG. 34, Panel D, and consistent with the denaturing conditions of the LC/MS method that was employed. The first structure corresponds to the D2/D4/D6 portion of the tetrahedral antibody; the second structure corresponds to the D1/D3 portion of the tetrahedral antibody. The yield of the correctly paired VH/VL construct contained within the D2/D4/D6 portion (L1L2H1H2) ranged from 97.1 to 99.5%; the yield of the correctly paired VH/VL construct contained within the D1/D3 portion (L1H1Fc) ranged from 99.4 to 99.8%.

TABLE 41

| Protein ID | L1 Chain | H1 Chain | L2 Chain | H2 Chain | Fc Chain |
|---|---|---|---|---|---|
| 18-01 | SEQ ID NO: 686 | SEQ ID NO: 641 | | | |
| 18-02 | SEQ ID NO: 686 | SEQ ID NO: 642 | | | |
| 18-03 | SEQ ID NO: 686 | SEQ ID NO: 643 | SEQ ID NO: 686 | SEQ ID NO: 644 | |
| 18-04 | SEQ ID NO: 686 | SEQ ID NO: 645 | SEQ ID NO: 686 | SEQ ID NO: 646 | |
| 18-05 | SEQ ID NO: 687 | SEQ ID NO: 647 | SEQ ID NO: 688 | SEQ ID NO: 648 | |
| 18-06 | SEQ ID NO: 689 | SEQ ID NO: 649 | SEQ ID NO: 690 | SEQ ID NO: 650 | |
| 18-07 | SEQ ID NO: 689 | SEQ ID NO: 649 | SEQ ID NO: 691 | SEQ ID NO: 651 | |
| 18-08 | SEQ ID NO: 692 | SEQ ID NO: 652 | SEQ ID NO: 693 | SEQ ID NO: 653 | |
| 18-09 | SEQ ID NO: 694 | SEQ ID NO: 654 | SEQ ID NO: 695 | SEQ ID NO: 655 | |
| 18-10 | SEQ ID NO: 694 | SEQ ID NO: 654 | SEQ ID NO: 696 | SEQ ID NO: 656 | |
| 18-11 | SEQ ID NO: 687 | SEQ ID NO: 647 | SEQ ID NO: 697 | SEQ ID NO: 657 | |
| 18-12 | SEQ ID NO: 689 | SEQ ID NO: 649 | SEQ ID NO: 698 | SEQ ID NO: 658 | |
| 18-13 | SEQ ID NO: 689 | SEQ ID NO: 649 | SEQ ID NO: 699 | SEQ ID NO: 659 | |
| 18-14 | SEQ ID NO: 687 | SEQ ID NO: 647 | SEQ ID NO: 697 | SEQ ID NO: 660 | SEQ ID NO: 706 |
| 18-15 | SEQ ID NO: 689 | SEQ ID NO: 649 | SEQ ID NO: 698 | SEQ ID NO: 661 | SEQ ID NO: 706 |
| 18-16 | SEQ ID NO: 689 | SEQ ID NO: 649 | SEQ ID NO: 699 | SEQ ID NO: 662 | SEQ ID NO: 706 |
| 18-17 | SEQ ID NO: 700 | SEQ ID NO: 663 | | | |
| 18-18 | SEQ ID NO: 700 | SEQ ID NO: 664 | | | |
| 18-19 | SEQ ID NO: 700 | SEQ ID NO: 665 | SEQ ID NO: 700 | SEQ ID NO: 666 | |
| 18-20 | SEQ ID NO: 700 | SEQ ID NO: 667 | SEQ ID NO: 700 | SEQ ID NO: 668 | |
| 18-21 | SEQ ID NO: 701 | SEQ ID NO: 669 | SEQ ID NO: 688 | SEQ ID NO: 648 | |
| 18-22 | SEQ ID NO: 702 | SEQ ID NO: 670 | SEQ ID NO: 690 | SEQ ID NO: 650 | |
| 18-23 | SEQ ID NO: 702 | SEQ ID NO: 670 | SEQ ID NO: 691 | SEQ ID NO: 651 | |
| 18-24 | SEQ ID NO: 701 | SEQ ID NO: 671 | SEQ ID NO: 693 | SEQ ID NO: 672 | |
| 18-25 | SEQ ID NO: 702 | SEQ ID NO: 673 | SEQ ID NO: 695 | SEQ ID NO: 674 | |
| 18-26 | SEQ ID NO: 702 | SEQ ID NO: 673 | SEQ ID NO: 696 | SEQ ID NO: 675 | |
| 18-27 | SEQ ID NO: 701 | SEQ ID NO: 669 | SEQ ID NO: 693 | SEQ ID NO: 653 | |
| 18-28 | SEQ ID NO: 702 | SEQ ID NO: 670 | SEQ ID NO: 695 | SEQ ID NO: 655 | |
| 18-29 | SEQ ID NO: 702 | SEQ ID NO: 670 | SEQ ID NO: 696 | SEQ ID NO: 656 | |
| 18-30 | SEQ ID NO: 701 | SEQ ID NO: 669 | SEQ ID NO: 693 | SEQ ID NO: 653 | SEQ ID NO: 706 |
| 18-31 | SEQ ID NO: 702 | SEQ ID NO: 670 | SEQ ID NO: 695 | SEQ ID NO: 655 | SEQ ID NO: 706 |
| 18-32 | SEQ ID NO: 702 | SEQ ID NO: 670 | SEQ ID NO: 696 | SEQ ID NO: 656 | SEQ ID NO: 706 |
| 18-33 | SEQ ID NO: 701 | SEQ ID NO: 669 | SEQ ID NO: 697 | SEQ ID NO: 657 | |
| 18-34 | SEQ ID NO: 702 | SEQ ID NO: 670 | SEQ ID NO: 698 | SEQ ID NO: 658 | |
| 18-35 | SEQ ID NO: 702 | SEQ ID NO: 670 | SEQ ID NO: 699 | SEQ ID NO: 659 | |
| 18-36 | SEQ ID NO: 701 | SEQ ID NO: 669 | SEQ ID NO: 697 | SEQ ID NO: 660 | SEQ ID NO: 706 |
| 18-37 | SEQ ID NO: 702 | SEQ ID NO: 670 | SEQ ID NO: 698 | SEQ ID NO: 661 | SEQ ID NO: 706 |
| 18-38 | SEQ ID NO: 702 | SEQ ID NO: 670 | SEQ ID NO: 699 | SEQ ID NO: 662 | SEQ ID NO: 706 |
| 18-39 | SEQ ID NO: 703 | SEQ ID NO: 676 | | | |
| 18-40 | SEQ ID NO: 703 | SEQ ID NO: 677 | | | |
| 18-41 | SEQ ID NO: 703 | SEQ ID NO: 678 | SEQ ID NO: 703 | SEQ ID NO: 679 | |
| 18-42 | SEQ ID NO: 703 | SEQ ID NO: 680 | SEQ ID NO: 703 | SEQ ID NO: 681 | |
| 18-43 | SEQ ID NO: 704 | SEQ ID NO: 682 | SEQ ID NO: 688 | SEQ ID NO: 648 | |
| 18-44 | SEQ ID NO: 705 | SEQ ID NO: 683 | SEQ ID NO: 690 | SEQ ID NO: 650 | |
| 18-45 | SEQ ID NO: 705 | SEQ ID NO: 683 | SEQ ID NO: 691 | SEQ ID NO: 651 | |
| 18-46 | SEQ ID NO: 704 | SEQ ID NO: 684 | SEQ ID NO: 693 | SEQ ID NO: 672 | |
| 18-47 | SEQ ID NO: 705 | SEQ ID NO: 685 | SEQ ID NO: 695 | SEQ ID NO: 674 | |
| 18-48 | SEQ ID NO: 705 | SEQ ID NO: 685 | SEQ ID NO: 696 | SEQ ID NO: 675 | |
| 18-49 | SEQ ID NO: 704 | SEQ ID NO: 682 | SEQ ID NO: 693 | SEQ ID NO: 653 | |
| 18-50 | SEQ ID NO: 705 | SEQ ID NO: 683 | SEQ ID NO: 695 | SEQ ID NO: 655 | |
| 18-51 | SEQ ID NO: 705 | SEQ ID NO: 683 | SEQ ID NO: 696 | SEQ ID NO: 656 | |
| 18-52 | SEQ ID NO: 704 | SEQ ID NO: 682 | SEQ ID NO: 693 | SEQ ID NO: 653 | SEQ ID NO: 706 |
| 18-53 | SEQ ID NO: 705 | SEQ ID NO: 683 | SEQ ID NO: 695 | SEQ ID NO: 655 | SEQ ID NO: 706 |
| 18-54 | SEQ ID NO: 705 | SEQ ID NO: 683 | SEQ ID NO: 696 | SEQ ID NO: 656 | SEQ ID NO: 706 |
| 18-55 | SEQ ID NO: 704 | SEQ ID NO: 682 | SEQ ID NO: 697 | SEQ ID NO: 657 | |
| 18-56 | SEQ ID NO: 705 | SEQ ID NO: 683 | SEQ ID NO: 698 | SEQ ID NO: 658 | |
| 18-57 | SEQ ID NO: 705 | SEQ ID NO: 683 | SEQ ID NO: 699 | SEQ ID NO: 659 | |
| 18-58 | SEQ ID NO: 704 | SEQ ID NO: 682 | SEQ ID NO: 697 | SEQ ID NO: 660 | SEQ ID NO: 706 |
| 18-59 | SEQ ID NO: 705 | SEQ ID NO: 683 | SEQ ID NO: 698 | SEQ ID NO: 661 | SEQ ID NO: 706 |
| 18-60 | SEQ ID NO: 705 | SEQ ID NO: 683 | SEQ ID NO: 699 | SEQ ID NO: 662 | SEQ ID NO: 706 |

TABLE 42

| Protein | D1-Fc | | | D5 | D4 | D3 | D6 | D2-Fc | | |
|---|---|---|---|---|---|---|---|---|---|---|
| ID | Fc Receptor binding | H1 | H2 | Fab | Fab | Fab | Fab | Fc Receptor binding | H1 | H2 |
| 18-01 | wt | | | | | | | | | |
| 18-02 | L234A/L235A/P329G | | | | | | | | | |
| 18-03 | wt | RF | HY | Da | Da | Da | Da | wt | RF | HY |
| 18-04 | L234A/L235A/P329G | RF | HY | Da | Da | Da | Da | L234A/L235A/P329G | RF | HY |
| 18-05 | L234A/L235A/P329G | RF | HY | HA9 | Da | Da | HA9 | L234A/L235A/P329G | RF | HY |
| 18-06 | L234A/L235A/P329G | RF | HY | HA9 | Da | Da | HA9 | L234A/L235A/P329G | RF | HY |
| 18-07 | L234A/L235A/P329G | RF | HY | HA9 | Da | Da | HA9 | L234A/L235A/P329G | RF | HY |

TABLE 42-continued

| Protein | D1-Fc | | | D5 | D4 | D3 | D6 | D2-Fc | | |
|---|---|---|---|---|---|---|---|---|---|---|
| ID | Fc Receptor binding | H1 | H2 | Fab | Fab | Fab | Fab | Fc Receptor binding | H1 | H2 |
| 18-08 | L234A/L235A/P329G | RF | HY | Da | HA9 | HA9 | Da | L234A/L235A/P329G | RF | HY |
| 18-09 | L234A/L235A/P329G | RF | HY | Da | HA9 | HA9 | Da | L234A/L235A/P329G | RF | HY |
| 18-10 | L234A/L235A/P329G | RF | HY | Da | HA9 | HA9 | Da | L234A/L235A/P329G | RF | HY |
| 18-11 | L234A/L235A/P329G | RF | HY | SP34 | Da | Da | SP34 | L234A/L235A/P329G | RF | HY |
| 18-12 | L234A/L235A/P329G | RF | HY | SP34 | Da | Da | SP34 | L234A/L235A/P329G | RF | HY |
| 18-13 | L234A/L235A/P329G | RF | HY | SP34 | Da | Da | SP34 | L234A/L235A/P329G | RF | HY |
| 18-14 | L234A/L235A/P329G | RF | HY | | Da | Da | SP34 | L234A/L235A/P329G | RF | RF |
| 18-15 | L234A/L235A/P329G | RF | HY | | Da | Da | SP34 | L234A/L235A/P329G | RF | RF |
| 18-16 | L234A/L235A/P329G | RF | HY | | Da | Da | SP34 | L234A/L235A/P329G | RF | RF |
| 18-17 | wt | | | | | | | | | |
| 18-18 | S239D/I332E | | | | | | | | | |
| 18-19 | wt | RF | HY | 4C8 | 4C8 | 4C8 | 4C8 | wt | RF | HY |
| 18-20 | S239D/I332E | RF | HY | 4C8 | 4C8 | 4C8 | 4C8 | S239D/I332E | RF | HY |
| 18-21 | L234A/L235A/P329G | RF | HY | HA9 | 4C8 | 4C8 | HA9 | L234A/L235A/P329G | RF | HY |
| 18-22 | L234A/L235A/P329G | RF | HY | HA9 | 4C8 | 4C8 | HA9 | L234A/L235A/P329G | RF | HY |
| 18-23 | L234A/L235A/P329G | RF | HY | HA9 | 4C8 | 4C8 | HA9 | L234A/L235A/P329G | RF | HY |
| 18-24 | wt | RF | HY | Da | 4C8 | 4C8 | Da | wt | RF | HY |
| 18-25 | wt | RF | HY | Da | 4C8 | 4C8 | Da | wt | RF | HY |
| 18-26 | wt | RF | HY | Da | 4C8 | 4C8 | Da | wt | RF | HY |
| 18-27 | L234A/L235A/P329G | RF | HY | Da | 4C8 | 4C8 | Da | L234A/L235A/P329G | RF | HY |
| 18-28 | L234A/L235A/P329G | RF | HY | Da | 4C8 | 4C8 | Da | L234A/L235A/P329G | RF | HY |
| 18-29 | L234A/L235A/P329G | RF | HY | Da | 4C8 | 4C8 | Da | L234A/L235A/P329G | RF | HY |
| 18-30 | L234A/L235A/P329G | RF | HY | | 4C8 | 4C8 | Da | L234A/L235A/P329G | RF | RF |
| 18-31 | L234A/L235A/P329G | RF | HY | | 4C8 | 4C8 | Da | L234A/L235A/P329G | RF | RF |
| 18-32 | L234A/L235A/P329G | RF | HY | | 4C8 | 4C8 | Da | L234A/L235A/P329G | RF | RF |
| 18-33 | L234A/L235A/P329G | RF | HY | SP34 | 4C8 | 4C8 | SP34 | L234A/L235A/P329G | RF | HY |
| 18-34 | L234A/L235A/P329G | RF | HY | SP34 | 4C8 | 4C8 | SP34 | L234A/L235A/P329G | RF | HY |
| 18-35 | L234A/L235A/P329G | RF | HY | SP34 | 4C8 | 4C8 | SP34 | L234A/L235A/P329G | RF | HY |
| 18-36 | L234A/L235A/P329G | RF | HY | | 4C8 | 4C8 | SP34 | L234A/L235A/P329G | RF | RF |
| 18-37 | L234A/L235A/P329G | RF | HY | | 4C8 | 4C8 | SP34 | L234A/L235A/P329G | RF | RF |
| 18-38 | L234A/L235A/P329G | RF | HY | | 4C8 | 4C8 | SP34 | L234A/L235A/P329G | RF | RF |
| 18-39 | wt | | | | | | | | | |
| 18-40 | S239D/I332E | | | | | | | | | |
| 18-41 | wt | RF | HY | B34 | B34 | B34 | B34 | wt | RF | HY |
| 18-42 | S239D/I332E | RF | HY | B34 | B34 | B34 | B34 | S239D/I332E | RF | HY |
| 18-43 | L234A/L235A/P329G | RF | HY | HA9 | B34 | B34 | HA9 | L234A/L235A/P329G | RF | HY |
| 18-44 | L234A/L235A/P329G | RF | HY | HA9 | B34 | B34 | HA9 | L234A/L235A/P329G | RF | HY |
| 18-45 | L234A/L235A/P329G | RF | HY | HA9 | B34 | B34 | HA9 | L234A/L235A/P329G | RF | HY |
| 18-46 | wt | RF | HY | Da | B34 | B34 | Da | wt | RF | HY |
| 18-47 | wt | RF | HY | Da | B34 | B34 | Da | wt | RF | HY |
| 18-48 | wt | RF | HY | Da | B34 | B34 | Da | wt | RF | HY |
| 18-49 | L234A/L235A/P329G | RF | HY | Da | B34 | B34 | Da | L234A/L235A/P329G | RF | HY |
| 18-50 | L234A/L235A/P329G | RF | HY | Da | B34 | B34 | Da | L234A/L235A/P329G | RF | HY |
| 18-51 | L234A/L235A/P329G | RF | HY | Da | B34 | B34 | Da | L234A/L235A/P329G | RF | HY |
| 18-52 | L234A/L235A/P329G | RF | HY | | B34 | B34 | Da | L234A/L235A/P329G | RF | RF |
| 18-53 | L234A/L235A/P329G | RF | HY | | B34 | B34 | Da | L234A/L235A/P329G | RF | RF |
| 18-54 | L234A/L235A/P329G | RF | HY | | B34 | B34 | Da | L234A/L235A/P329G | RF | RF |
| 18-55 | L234A/L235A/P329G | RF | HY | SP34 | B34 | B34 | SP34 | L234A/L235A/P329G | RF | HY |
| 18-56 | L234A/L235A/P329G | RF | HY | SP34 | B34 | B34 | SP34 | L234A/L235A/P329G | RF | HY |
| 18-57 | L234A/L235A/P329G | RF | HY | SP34 | B34 | B34 | SP34 | L234A/L235A/P329G | RF | HY |
| 18-58 | L234A/L235A/P329G | RF | HY | | B34 | B34 | SP34 | L234A/L235A/P329G | RF | RF |
| 18-59 | L234A/L235A/P329G | RF | HY | | B34 | B34 | SP34 | L234A/L235A/P329G | RF | RF |
| 18-60 | L234A/L235A/P329G | RF | HY | | B34 | B34 | SP34 | L234A/L235A/P329G | RF | RF |

TABLE 43

| Protein ID | D1 Target | D5 Target | D4 Target | D3 Target | D6 Target | D2-Fc | Other |
|---|---|---|---|---|---|---|---|
| 18-01 | FcγR | | | | | | α-CD38 mAb |
| 18-02 | Fc silent | | | | | | α-CD38 mAb |
| 18-03 | FcγR | CD38 | CD38 | CD38 | CD38 | FcgR | |
| 18-04 | Fc silent | CD38 | CD38 | CD38 | CD38 | Fc silent | |
| 18-05 | Fc silent | CD16 | CD38 | CD38 | CD16 | Fc silent | |
| 18-06 | Fc silent | CD16 | CD38 | CD38 | CD16 | Fc silent | |
| 18-07 | Fc silent | CD16 | CD38 | CD38 | CD16 | Fc silent | |
| 18-08 | Fc silent | CD38 | CD16 | CD16 | CD38 | Fc silent | |
| 18-09 | Fc silent | CD38 | CD16 | CD16 | CD38 | Fc silent | |
| 18-10 | Fc silent | CD38 | CD16 | CD16 | CD38 | Fc silent | |
| 18-11 | Fc silent | CD3 | CD38 | CD38 | CD3 | Fc silent | |
| 18-12 | Fc silent | CD3 | CD38 | CD38 | CD3 | Fc silent | |
| 18-13 | Fc silent | CD3 | CD38 | CD38 | CD3 | Fc silent | |
| 18-14 | Fc silent | | CD38 | CD38 | CD3 | Fc silent | |
| 18-15 | Fc silent | | CD38 | CD38 | CD3 | Fc silent | |

TABLE 43-continued

| Protein ID | D1 Target | D5 Target | D4 Target | D3 Target | D6 Target | D2-Fc | Other |
|---|---|---|---|---|---|---|---|
| 18-16 | Fc silent | | CD38 | CD38 | CD3 | Fc silent | |
| 18-17 | FcγR | | | | | | α-BCMA mAb |
| 18-18 | FcγR-high | | | | | | α-BCMA mAb |
| 18-19 | FcγR | BCMA | BCMA | BCMA | BCMA | FcgR | |
| 18-20 | FcγR-high | BCMA | BCMA | BCMA | BCMA | FcgR-high | |
| 18-21 | Fc silent | CD16 | BCMA | BCMA | CD16 | Fc silent | |
| 18-22 | Fc silent | CD16 | BCMA | BCMA | CD16 | Fc silent | |
| 18-23 | Fc silent | CD16 | BCMA | BCMA | CD16 | Fc silent | |
| 18-24 | FcγR | CD38 | BCMA | BCMA | CD38 | FcγR | |
| 18-25 | FcγR | CD38 | BCMA | BCMA | CD38 | FcγR | |
| 18-26 | FcγR | CD38 | BCMA | BCMA | CD38 | FcγR | |
| 18-27 | Fc silent | CD38 | BCMA | BCMA | CD38 | Fc silent | |
| 18-28 | Fc silent | CD38 | BCMA | BCMA | CD38 | Fc silent | |
| 18-29 | Fc silent | CD38 | BCMA | BCMA | CD38 | Fc silent | |
| 18-30 | Fc silent | | BCMA | BCMA | CD38 | Fc silent | |
| 18-31 | Fc silent | | BCMA | BCMA | CD38 | Fc silent | |
| 18-32 | Fc silent | | BCMA | BCMA | CD38 | Fc silent | |
| 18-33 | Fc silent | CD3 | BCMA | BCMA | CD3 | Fc silent | |
| 18-34 | Fc silent | CD3 | BCMA | BCMA | CD3 | Fc silent | |
| 18-35 | Fc silent | CD3 | BCMA | BCMA | CD3 | Fc silent | |
| 18-36 | Fc silent | | BCMA | BCMA | CD3 | Fc silent | |
| 18-37 | Fc silent | | BCMA | BCMA | CD3 | Fc silent | |
| 18-38 | Fc silent | | BCMA | BCMA | CD3 | Fc silent | |
| 18-39 | FcγR | | | | | | α-BCMA mAb |
| 18-40 | FcγR-high | | | | | | α-BCMA mAb |
| 18-41 | FcγR | BCMA | BCMA | BCMA | BCMA | FcgR | |
| 18-42 | FcγR-high | BCMA | BCMA | BCMA | BCMA | FcgR-high | |
| 18-43 | Fc silent | CD16 | BCMA | BCMA | CD16 | Fc silent | |
| 18-44 | Fc silent | CD16 | BCMA | BCMA | CD16 | Fc silent | |
| 18-45 | Fc silent | CD16 | BCMA | BCMA | CD16 | Fc silent | |
| 18-46 | FcγR | CD38 | BCMA | BCMA | CD38 | FcγR | |
| 18-47 | FcγR | CD38 | BCMA | BCMA | CD38 | FcγR | |
| 18-48 | FcγR | CD38 | BCMA | BCMA | CD38 | FcγR | |
| 18-49 | Fc silent | CD38 | BCMA | BCMA | CD38 | Fc silent | |
| 18-50 | Fc silent | CD38 | BCMA | BCMA | CD38 | Fc silent | |
| 18-51 | Fc silent | CD38 | BCMA | BCMA | CD38 | Fc silent | |
| 18-52 | Fc silent | | BCMA | BCMA | CD38 | Fc silent | |
| 18-53 | Fc silent | | BCMA | BCMA | CD38 | Fc silent | |
| 18-54 | Fc silent | | BCMA | BCMA | CD38 | Fc silent | |
| 18-55 | Fc silent | CD3 | BCMA | BCMA | CD3 | Fc silent | |
| 18-56 | Fc silent | CD3 | BCMA | BCMA | CD3 | Fc silent | |
| 18-57 | Fc silent | CD3 | BCMA | BCMA | CD3 | Fc silent | |
| 18-58 | Fc silent | | BCMA | BCMA | CD3 | Fc silent | |
| 18-59 | Fc silent | | BCMA | BCMA | CD3 | Fc silent | |
| 18-60 | Fc silent | | BCMA | BCMA | CD3 | Fc silent | |

TABLE 44

| | L1 Chain | | H1 Chain | | L2 Chain | | H2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 18-01 | VK-CK | | VH-CH1 | | | | | |
| 18-02 | VK-CK | | VH-CH1 | | | | | |
| 18-03 | VK-CK | | VH-CH1 | | VK-CK | | VH-CH1 | |
| 18-04 | VK-CK | | VH-CH1 | | VK-CK | | VH-CH1 | |
| 18-05 | VK-CK | E123R/Q124K | VH-CH1 | K147E/K213E | VH-CK | | VK-CH1 | |
| 18-06 | VK-CK | Q38E/V133K | VH-CH1 | Q39K/S183E | VH-CK | Q39K/V133E | VK-CH1 | Q38E/S183K |
| 18-07 | VK-CK | Q38E/V133K | VH-CH1 | Q39K/S183E | VH-CK | Q39E/V133E | VK-CH1 | Q38K/S183K |
| 18-08 | VK-CK | E123R/Q124K | VH-CH1 | K147E/K213E | VH-CK | | VK-CH1 | |
| 18-09 | VK-CK | Q38E/V133K | VH-CH1 | Q39K/S183E | VH-CK | Q39K/V133E | VK-CH1 | Q38E/S183K |
| 18-10 | VK-CK | Q38E/V133K | VH-CH1 | Q39K/S183E | VH-CK | Q39E/V133E | VK-CH1 | Q38K/S183K |
| 18-11 | VK-CK | E123R/Q124K | VH-CH1 | K147E/K213E | VH-CK | | VK-CH1 | |
| 18-12 | VK-CK | Q38E/V133K | VH-CH1 | Q39K/S183E | VH-CK | Q39K/V133E | VK-CH1 | Q38E/S183K |
| 18-13 | VK-CK | Q38E/V133K | VH-CH1 | Q39K/S183E | VH-CK | Q39E/V133E | VK-CH1 | Q38K/S183K |
| 18-14 | VK-CK | E123R/Q124K | VH-CH1 | K147E/K213E | VH-CK | | VK-CH1 | |
| 18-15 | VK-CK | Q38E/V133K | VH-CH1 | Q39K/S183E | VH-CK | Q39K/V133E | VK-CH1 | Q38E/S183K |
| 18-16 | VK-CK | Q38E/V133K | VH-CH1 | Q39K/S183E | VH-CK | Q39E/V133E | VK-CH1 | Q38K/S183K |
| 18-17 | VK-CK | | VH-CH1 | | | | | |
| 18-18 | VK-CK | | VH-CH1 | | | | | |
| 18-19 | VK-CK | | VH-CH1 | | VK-CK | | VH-CH1 | |
| 18-20 | VK-CK | | VH-CH1 | | VK-CK | | VH-CH1 | |
| 18-21 | VK-CK | E123R/Q124K | VH-CH1 | K147E/K213E | VH-CK | | VK-CH1 | |
| 18-22 | VK-CK | Q38E/V133K | VH-CH1 | Q39K/S183E | VH-CK | Q39K/V133E | VK-CH1 | Q38E/S183K |

TABLE 44-continued

| | L1 Chain | | H1 Chain | | L2 Chain | | H2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 18-23 | VK-CK | Q38E/V133K | VH-CH1 | Q39K/S183E | VH-CK | Q39E/V133E | VK-CH1 | Q38K/S183K |
| 18-24 | VK-CK | E123R/Q124K | VH-CH1 | K147E/K213E | VH-CK | | VK-CH1 | |
| 18-25 | VK-CK | Q38E/V133K | VH-CH1 | Q39K/S183E | VH-CK | Q39K/V133E | VK-CH1 | Q38E/S183K |
| 18-26 | VK-CK | Q38E/V133K | VH-CH1 | Q39K/S183E | VH-CK | Q39E/V133E | VK-CH1 | Q38K/S183K |
| 18-27 | VK-CK | E123R/Q124K | VH-CH1 | K147E/K213E | VH-CK | | VK-CH1 | |
| 18-28 | VK-CK | Q38E/V133K | VH-CH1 | Q39K/S183E | VH-CK | Q39K/V133E | VK-CH1 | Q38E/S183K |
| 18-29 | VK-CK | Q38E/V133K | VH-CH1 | Q39K/S183E | VH-CK | Q39E/V133E | VK-CH1 | Q38K/S183K |
| 18-30 | VK-CK | E123R/Q124K | VH-CH1 | K147E/K213E | VH-CK | | VK-CH1 | |
| 18-31 | VK-CK | Q38E/V133K | VH-CH1 | Q39K/S183E | VH-CK | Q39K/V133E | VK-CH1 | Q38E/S183K |
| 18-32 | VK-CK | Q38E/V133K | VH-CH1 | Q39K/S183E | VH-CK | Q39E/V133E | VK-CH1 | Q38K/S183K |
| 18-33 | VK-CK | E123R/Q124K | VH-CH1 | K147E/K213E | VH-CK | | VK-CH1 | |
| 18-34 | VK-CK | Q38E/V133K | VH-CH1 | Q39K/S183E | VH-CK | Q39K/V133E | VK-CH1 | Q38E/S183K |
| 18-35 | VK-CK | Q38E/V133K | VH-CH1 | Q39K/S183E | VH-CK | Q39E/V133E | VK-CH1 | Q38K/S183K |
| 18-36 | VK-CK | E123R/Q124K | VH-CH1 | K147E/K213E | VH-CK | | VK-CH1 | |
| 18-37 | VK-CK | Q38E/V133K | VH-CH1 | Q39K/S183E | VH-CK | Q39K/V133E | VK-CH1 | Q38E/S183K |
| 18-38 | VK-CK | Q38E/V133K | VH-CH1 | Q39K/S183E | VH-CK | Q39E/V133E | VK-CH1 | Q38K/S183K |
| 18-39 | VK-CK | | VH-CH1 | | | | | |
| 18-40 | VK-CK | | VH-CH1 | | | | | |
| 18-41 | VK-CK | | VH-CH1 | | VK-CK | | VH-CH1 | |
| 18-42 | VK-CK | | VH-CH1 | | VK-CK | | VH-CH1 | |
| 18-43 | VK-CK | E123R/Q124K | VH-CH1 | K147E/K213E | VK-CK | | VK-CH1 | |
| 18-44 | VK-CK | Q38E/V133K | VH-CH1 | Q39K/S183E | VH-CK | Q39K/V133E | VK-CH1 | Q38E/S183K |
| 18-45 | VK-CK | Q38E/V133K | VH-CH1 | Q39K/S183E | VH-CK | Q39E/V133E | VK-CH1 | Q38K/S183K |
| 18-46 | VK-CK | E123R/Q124K | VH-CH1 | K147E/K213E | VH-CK | | VK-CH1 | |
| 18-47 | VK-CK | Q38E/V133K | VH-CH1 | Q39K/S183E | VH-CK | Q39K/V133E | VK-CH1 | Q38E/S183K |
| 18-48 | VK-CK | Q38E/V133K | VH-CH1 | Q39K/S183E | VH-CK | Q39E/V133E | VK-CH1 | Q38K/S183K |
| 18-49 | VK-CK | E123R/Q124K | VH-CH1 | K147E/K213E | VH-CK | | VK-CH1 | |
| 18-50 | VK-CK | Q38E/V133K | VH-CH1 | Q39K/S183E | VH-CK | Q39K/V133E | VK-CH1 | Q38E/S183K |
| 18-51 | VK-CK | Q38E/V133K | VH-CH1 | Q39K/S183E | VH-CK | Q39E/V133E | VK-CH1 | Q38K/S183K |
| 18-52 | VK-CK | E123R/Q124K | VH-CH1 | K147E/K213E | VH-CK | | VK-CH1 | |
| 18-53 | VK-CK | Q38E/V133K | VH-CH1 | Q39K/S183E | VH-CK | Q39K/V133E | VK-CH1 | Q38E/S183K |
| 18-54 | VK-CK | Q38E/V133K | VH-CH1 | Q39K/S183E | VH-CK | Q39E/V133E | VK-CH1 | Q38K/S183K |
| 18-55 | VK-CK | E123R/Q124K | VH-CH1 | K147E/K213E | VH-CK | | VK-CH1 | |
| 18-56 | VK-CK | Q38E/V133K | VH-CH1 | Q39K/S183E | VH-CK | Q39K/V133E | VK-CH1 | Q38E/S183K |
| 18-57 | VK-CK | Q38E/V133K | VH-CH1 | Q39K/S183E | VH-CK | Q39E/V133E | VK-CH1 | Q38K/S183K |
| 18-58 | VK-CK | E123R/Q124K | VH-CH1 | K147E/K213E | VH-CK | | VK-CH1 | |
| 18-59 | VK-CK | Q38E/V133K | VH-CH1 | Q39K/S183E | VH-CK | Q39K/V133E | VK-CH1 | Q38E/S183K |
| 18-60 | VK-CK | Q38E/V133K | VH-CH1 | Q39K/S183E | VH-CK | Q39E/V133E | VK-CH1 | Q38K/S183K |

TABLE 45

| Protein | L1L1H1H2 | L1L2H1H2 | L2L2H1H2 | Delta, | Theoretical Average Intact Mass, Da | | | | |
|---|---|---|---|---|---|---|---|---|---|
| ID | (%) | (%) | (%) | Da | L1L1H1H2 | L1L2H1H2 | L2L2H1H2 | L1H1Fc | L2H1Fc |
| 18-05 | 0.4% | 95.8% | *3.8% | 1048 | 161216 | 162264 | 163312 | | |
| 18-06 | 0.4% | 95.3% | *4.3% | 1075 | 161304 | 162379 | 163455 | | |
| 18-07 | 0.4% | 94.6% | *5.0% | 1076 | 161303 | 162379 | 163455 | | |
| 18-08 | 0.3% | 97.9% | 1.8% | 1200 | 161064 | 162264 | 163465 | | |
| 18-09 | 0.2% | 98.2% | 1.6% | 1228 | 161099 | 162327 | 163554 | | |
| 18-10 | 0.6% | 97.9% | 1.4% | 1228 | 161151 | 162379 | 163608 | | |
| 18-21 | 0.8% | 94.3% | *4.9% | 976 | 161150 | 162126 | 163102 | | |
| 18-22 | 1.3% | 97.7% | 1.0% | 1132 | 161238 | 162370 | 163503 | | |
| 18-23 | 0.5% | 96.7% | 2.8% | 1133 | 161237 | 162370 | 163503 | | |
| 18-24 | 0.7% | 97.3% | 2.0% | 1447 | 161210 | 162656 | 164103 | | |
| 18-25 | 0.7% | 97.8% | 1.5% | 1474 | 161298 | 162771 | 164245 | | |
| 18-26 | 0.9% | 98.7% | 0.4% | 1475 | 161297 | 162771 | 164246 | | |
| 18-27 | 0.6% | 96.8% | 2.6% | 1475 | 160961 | 162408 | 163854 | | |
| 18-28 | 1.0% | 96.8% | 2.2% | 1474 | 161049 | 162523 | 163997 | | |
| 18-29 | 0.5% | 98.0% | 1.5% | 1475 | 161048 | 162523 | 163998 | | |
| 18-30 | 0.0% | 97.1% | 2.9% | 1447 | 188158 | 189605 | 191051 | 99.4% | 0.6% |
| 18-31 | 0.0% | 98.3% | 1.7% | 1474 | 188249 | 189723 | 191197 | 99.8% | 0.2% |
| 18-32 | 0.0% | 99.5% | 0.5% | 1475 | 188248 | 189723 | 191198 | 99.7% | 0.3% |

Example 21—Pentavalent/Hexavalent, Trispecific Tetrahedral Antibodies Comprising Two Distinct Fabs that Specifically Bind CD19, CD20 and the 4-1BB Receptor Tetrahedral antibodies offer a unique opportunity to exploit the contribution of dimensionality in creating multivalent, multispecific targeting agents for the treatment of cancer and other disease. Accordingly, a series of constructs was generated with the predicted structures shown in panel C of FIG. 40, thus enabling the evaluation and application of their trispecificity.

This series of trispecific constructs employed VH and VL regions from FMC63, an FDA-approved anti-CD19 antibody used in the form of a chimeric antigen receptor (CAR-T) to treat B cell cancer (SEQ ID Nos 734, 708), and rituximab, an FDA-approved standalone anti-CD20 antibody used to treat B cell cancer and inflammatory disease (SEQ ID Nos 739, 713). Additionally, this series of trispecific constructs employed a single chain 4-1BB ligand (SEQ ID No 844) (Tables 46, 47, 48), and optionally employ a single chain OX40 ligand (SEQ ID No 845), or single chain GITR ligand (SEQ ID No 846). The targeting CD19 and CD20 by a single therapeutic agent offers a significant opportunity in the treatment and prevention of resistance and remission in B cell cancer, while the simultaneous delivery of 4-1BBL, OX40L or GITRL offers a significant opportunity to activate NK cells and T cells in the vicinity of the cancer.

To optimize correct VH/VL pairing and to minimize VH/VL mispairing, V region exchange was combined with electrostatic steering as described in Example 18 (Table 49). Additionally, to further facilitate purification of the correctly paired product by Protein A chromatography, the H1 chain incorporated the H435R/Y436F substitution. The constructs are then evaluated for their structural trispecificity by intact mass spectrometry, following removal of N-glycan and O-glycan, as described in Example 18. These constructs and those of Example 20 are further evaluated for their functional bi- and trispecificity using a variety of in vitro and in vivo cancer cell targeting and cytotoxicity models that are well known to one skilled in the art.

TABLE 46

| Protein ID | L1 Chain | H1 Chain | L2 Chain | H2 Chain |
|---|---|---|---|---|
| 19-01 | SEQ ID NO: 733 | SEQ ID NO: 707 | SEQ ID NO: 734 | SEQ ID NO: 708 |
| 19-02 | SEQ ID NO: 735 | SEQ ID NO: 709 | SEQ ID NO: 736 | SEQ ID NO: 710 |
| 19-03 | SEQ ID NO: 735 | SEQ ID NO: 709 | SEQ ID NO: 737 | SEQ ID NO: 711 |
| 19-04 | SEQ ID NO: 738 | SEQ ID NO: 712 | SEQ ID NO: 739 | SEQ ID NO: 713 |
| 19-05 | SEQ ID NO: 740 | SEQ ID NO: 714 | SEQ ID NO: 741 | SEQ ID NO: 715 |
| 19-06 | SEQ ID NO: 740 | SEQ ID NO: 714 | SEQ ID NO: 742 | SEQ ID NO: 716 |
| 19-07 | SEQ ID NO: 733 | SEQ ID NO: 707 | SEQ ID NO: 734 | SEQ ID NO: 717 |
| 19-08 | SEQ ID NO: 735 | SEQ ID NO: 709 | SEQ ID NO: 736 | SEQ ID NO: 718 |
| 19-09 | SEQ ID NO: 735 | SEQ ID NO: 709 | SEQ ID NO: 737 | SEQ ID NO: 719 |
| 19-10 | SEQ ID NO: 738 | SEQ ID NO: 712 | SEQ ID NO: 739 | SEQ ID NO: 720 |
| 19-11 | SEQ ID NO: 740 | SEQ ID NO: 714 | SEQ ID NO: 741 | SEQ ID NO: 721 |
| 19-12 | SEQ ID NO: 740 | SEQ ID NO: 714 | SEQ ID NO: 742 | SEQ ID NO: 722 |
| 19-13 | SEQ ID NO: 733 | SEQ ID NO: 723 | SEQ ID NO: 734 | SEQ ID NO: 724 |
| 19-14 | SEQ ID NO: 735 | SEQ ID NO: 725 | SEQ ID NO: 736 | SEQ ID NO: 726 |
| 19-15 | SEQ ID NO: 735 | SEQ ID NO: 725 | SEQ ID NO: 737 | SEQ ID NO: 727 |
| 19-16 | SEQ ID NO: 738 | SEQ ID NO: 728 | SEQ ID NO: 739 | SEQ ID NO: 729 |
| 19-17 | SEQ ID NO: 740 | SEQ ID NO: 730 | SEQ ID NO: 741 | SEQ ID NO: 731 |
| 19-18 | SEQ ID NO: 740 | SEQ ID NO: 730 | SEQ ID NO: 742 | SEQ ID NO: 732 |

TABLE 47

| Protein ID | D1-Fc | D7 | D5-Fab | D4-Fab | D3-Fab | D6-Fab | D8 | D2-Fc |
|---|---|---|---|---|---|---|---|---|
| 19-01 | | | FMC63 | Rituximab | Rituximab | FMC63 | | |
| 19-02 | | | FMC63 | Rituximab | Rituximab | FMC63 | | |
| 19-03 | | | FMC63 | Rituximab | Rituximab | FMC63 | | |
| 19-04 | | | Rituximab | FMC63 | FMC63 | Rituximab | | |
| 19-05 | | | Rituximab | FMC63 | FMC63 | Rituximab | | |
| 19-06 | | | Rituximab | FMC63 | FMC63 | Rituximab | | |
| 19-07 | | 4-1BBL | FMC63 | Rituximab | Rituximab | FMC63 | 4-1BBL | |
| 19-08 | | 4-1BBL | FMC63 | Rituximab | Rituximab | FMC63 | 4-1BBL | |
| 19-09 | | 4-1BBL | FMC63 | Rituximab | Rituximab | FMC63 | 4-1BBL | |
| 19-10 | | 4-1BBL | Rituximab | FMC63 | FMC63 | Rituximab | 4-1BBL | |
| 19-11 | | 4-1BBL | Rituximab | FMC63 | FMC63 | Rituximab | 4-1BBL | |
| 19-12 | | 4-1BBL | Rituximab | FMC63 | FMC63 | Rituximab | 4-1BBL | |
| 19-13 | L234A/L235A/P329G | 4-1BBL | FMC63 | Rituximab | Rituximab | FMC63 | 4-1BBL | L234A/L235A/P329G |
| 19-14 | L234A/L235A/P329G | 4-1BBL | FMC63 | Rituximab | Rituximab | FMC63 | 4-1BBL | L234A/L235A/P329G |
| 19-15 | L234A/L235A/P329G | 4-1BBL | FMC63 | Rituximab | Rituximab | FMC63 | 4-1BBL | L234A/L235A/P329G |
| 19-16 | L234A/L235A/P329G | 4-1BBL | Rituximab | FMC63 | FMC63 | Rituximab | 4-1BBL | L234A/L235A/P329G |
| 19-17 | L234A/L235A/P329G | 4-1BBL | Rituximab | FMC63 | FMC63 | Rituximab | 4-1BBL | L234A/L235A/P329G |
| 19-18 | L234A/L235A/P329G | 4-1BBL | Rituximab | FMC63 | FMC63 | Rituximab | 4-1BBL | L234A/L235A/P329G |

TABLE 48

| Protein ID | D1 Target | D7 Target | D5 Target | D4 Target | D3 Target | D6 Target | D8 Target | D2 Target |
|---|---|---|---|---|---|---|---|---|
| 19-01 | FcgR | | CD19 | CD20 | CD20 | CD19 | | FcgR |
| 19-02 | FcgR | | CD19 | CD20 | CD20 | CD19 | | FcgR |
| 19-03 | FcgR | | CD19 | CD20 | CD20 | CD19 | | FcgR |
| 19-04 | FcgR | | CD20 | CD19 | CD19 | CD20 | | FcgR |
| 19-05 | FcgR | | CD20 | CD19 | CD19 | CD20 | | FcgR |
| 19-06 | FcgR | | CD20 | CD19 | CD19 | CD20 | | FcgR |
| 19-07 | FcgR | 4-1BBR | CD19 | CD20 | CD20 | CD19 | 4-1BBR | FcgR |
| 19-08 | FcgR | 4-1BBR | CD19 | CD20 | CD20 | CD19 | 4-1BBR | FcgR |
| 19-09 | FcgR | 4-1BBR | CD19 | CD20 | CD20 | CD19 | 4-1BBR | FcgR |
| 19-10 | FcgR | 4-1BBR | CD20 | CD19 | CD19 | CD20 | 4-1BBR | FcgR |
| 19-11 | FcgR | 4-1BBR | CD20 | CD19 | CD19 | CD20 | 4-1BBR | FcgR |
| 19-12 | FcgR | 4-1BBR | CD20 | CD19 | CD19 | CD20 | 4-1BBR | FcgR |
| 19-13 | Fc silent | 4-1BBR | CD19 | CD20 | CD20 | CD19 | 4-1BBR | Fc silent |
| 19-14 | Fc silent | 4-1BBR | CD19 | CD20 | CD20 | CD19 | 4-1BBR | Fc silent |
| 19-15 | Fc silent | 4-1BBR | CD19 | CD20 | CD20 | CD19 | 4-1BBR | Fc silent |
| 19-16 | Fc silent | 4-1BBR | CD20 | CD19 | CD19 | CD20 | 4-1BBR | Fc silent |
| 19-17 | Fc silent | 4-1BBR | CD20 | CD19 | CD19 | CD20 | 4-1BBR | Fc silent |
| 19-18 | Fc silent | 4-1BBR | CD20 | CD19 | CD19 | CD20 | 4-1BBR | Fc silent |

TABLE 49

| | L1 Chain | | H1 Chain | | L2 Chain | | H2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 19-01 | VK-CK | E123R/Q124K | VH-CH1 | K147E/K213E | VH-CK | | VK-CH1 | |
| 19-02 | VK-CK | Q38E/V133K | VH-CH1 | Q39K/S183E | VH-CK | Q39K/V133E | VK-CH1 | Q38E/S183K |
| 19-03 | VK-CK | Q38E/V133K | VH-CH1 | Q39K/S183E | VH-CK | Q39E/V133E | VK-CH1 | Q38K/S183K |
| 19-04 | VK-CK | E123R/Q124K | VH-CH1 | K147E/K213E | VH-CK | | VK-CH1 | |
| 19-05 | VK-CK | Q38E/V133K | VH-CH1 | Q39K/S183E | VH-CK | Q39K/V133E | VK-CH1 | Q38E/S183K |
| 19-06 | VK-CK | Q38E/V133K | VH-CH1 | Q39K/S183E | VH-CK | Q39E/V133E | VK-CH1 | Q38K/S183K |
| 19-07 | VK-CK | E123R/Q124K | VH-CH1 | K147E/K213E | VH-CK | | VK-CH1 | |
| 19-08 | VK-CK | Q38E/V133K | VH-CH1 | Q39K/S183E | VH-CK | Q39K/V133E | VK-CH1 | Q38E/S183K |
| 19-09 | VK-CK | Q38E/V133K | VH-CH1 | Q39K/S183E | VH-CK | Q39E/V133E | VK-CH1 | Q38K/S183K |
| 19-10 | VK-CK | E123R/Q124K | VH-CH1 | K147E/K213E | VH-CK | | VK-CH1 | |
| 19-11 | VK-CK | Q38E/V133K | VH-CH1 | Q39K/S183E | VH-CK | Q39K/V133E | VK-CH1 | Q38E/S183K |
| 19-12 | VK-CK | Q38E/V133K | VH-CH1 | Q39K/S183E | VH-CK | Q39E/V133E | VK-CH1 | Q38K/S183K |
| 19-13 | VK-CK | E123R/Q124K | VH-CH1 | K147E/K213E | VH-CK | | VK-CH1 | |
| 19-14 | VK-CK | Q38E/V133K | VH-CH1 | Q39K/S183E | VH-CK | Q39K/V133E | VK-CH1 | Q38E/S183K |
| 19-15 | VK-CK | Q38E/V133K | VH-CH1 | Q39K/S183E | VH-CK | Q39E/V133E | VK-CH1 | Q38K/S183K |
| 19-16 | VK-CK | E123R/Q124K | VH-CH1 | K147E/K213E | VH-CK | | VK-CH1 | |
| 19-17 | VK-CK | Q38E/V133K | VH-CH1 | Q39K/S183E | VH-CK | Q39K/V133E | VK-CH1 | Q38E/S183K |
| 19-18 | VK-CK | Q38E/V133K | VH-CH1 | Q39K/S183E | VH-CK | Q39E/V133E | VK-CH1 | Q38K/S183K |

Example 22—Trivalent/Tetravalent, Bispecific Tetrahedral Antibodies Comprising Two Distinct Fabs that Specifically Bind CD3 and either CD19 or CD20

Tetrahedral antibodies incorporating an anti-CD3 domain were designed, expressed, and evaluated for their ability to co-engage T cells and disease target cells for the treatment of cancer and other disease. This series of bispecific constructs employ VH and VL regions from rituximab (anti-CD20), FMC63 (anti-CD19), or obinutuzumab (anti-CD20) to engage target cells, together with VH and VL regions from SP34 (anti-CD3) to engage T cells (Tables 50, 51). Two tetrahedral antibody configurations were employed (Table 52). In the first configuration, the disease targeting Fab domain (anti-CD19 or anti-CD20) is placed in D3/D4 (bivalent), the T cell engaging Fab domain is placed in D6 (monovalent) and/or D5/D6 (bivalent), and D1/D2 are Fc domains. In the second configuration, the disease targeting Fab domain (anti-CD19 or anti-CD20) is placed in D3/D4 (bivalent), the T cell engaging Fab domain is placed in D2 (monovalent), and D1 is an Fc domain. To optimize correct VH/VL pairing and to minimize VH/VL mispairing, V region exchange was combined with three different sets of charge pairs to ensure correct pairing of heavy and light chain V regions (Table 53). Additionally, to further facilitate purification of the correctly paired product by Protein A chromatography, for bivalent CD3, the H1 chain incorporated the H435R/Y436F substitution (for bivalent CD3); for monovalent CD3, both the H1 and H2 chains incorporated the H435R/Y436F substitution. The constructs are then evaluated for their structural bispecificity by intact mass spectrometry as described in Example 18, and for their functional bispecificity using a variety of in vitro binding assays, cytotoxicity assays, and cytokine induction and release assays, and in vivo cancer efficacy models, known to one skilled in the art.

TABLE 50

| Protein ID | H1 Chain | H2 Chain | L1 Chain | L2 Chain | Fc Chain | H3 Chain |
|---|---|---|---|---|---|---|
| 20-01 | SEQ ID NO: 4658 | SEQ ID NO: 4659 | SEQ ID NO: 4685 | SEQ ID NO: 4686 | SEQ ID NO: 4694 | |
| 20-02 | SEQ ID NO: 4660 | SEQ ID NO: 4661 | SEQ ID NO: 4687 | SEQ ID NO: 4688 | SEQ ID NO: 4694 | |
| 20-03 | SEQ ID NO: 4660 | SEQ ID NO: 4662 | SEQ ID NO: 4687 | SEQ ID NO: 4689 | SEQ ID NO: 4694 | |
| 20-04 | SEQ ID NO: 4658 | SEQ ID NO: 4659 | SEQ ID NO: 4685 | SEQ ID NO: 4686 | | SEQ ID NO: 4663 |
| 20-05 | SEQ ID NO: 4660 | SEQ ID NO: 4661 | SEQ ID NO: 4687 | SEQ ID NO: 4688 | | SEQ ID NO: 4664 |
| 20-06 | SEQ ID NO: 4660 | SEQ ID NO: 4662 | SEQ ID NO: 4687 | SEQ ID NO: 4689 | | SEQ ID NO: 4664 |
| 20-07 | SEQ ID NO: 4658 | SEQ ID NO: 4665 | SEQ ID NO: 4685 | SEQ ID NO: 4686 | SEQ ID NO: 4694 | |
| 20-08 | SEQ ID NO: 4660 | SEQ ID NO: 4666 | SEQ ID NO: 4687 | SEQ ID NO: 4688 | SEQ ID NO: 4694 | |
| 20-09 | SEQ ID NO: 4660 | SEQ ID NO: 4667 | SEQ ID NO: 4687 | SEQ ID NO: 4689 | SEQ ID NO: 4694 | |
| 20-10 | SEQ ID NO: 4658 | SEQ ID NO: 4665 | SEQ ID NO: 4685 | SEQ ID NO: 4686 | | SEQ ID NO: 4663 |
| 20-11 | SEQ ID NO: 4660 | SEQ ID NO: 4666 | SEQ ID NO: 4687 | SEQ ID NO: 4688 | | SEQ ID NO: 4664 |
| 20-12 | SEQ ID NO: 4660 | SEQ ID NO: 4667 | SEQ ID NO: 4687 | SEQ ID NO: 4689 | | SEQ ID NO: 4664 |
| 20-13 | SEQ ID NO: 4668 | SEQ ID NO: 4659 | SEQ ID NO: 4690 | SEQ ID NO: 4686 | SEQ ID NO: 4694 | |
| 20-14 | SEQ ID NO: 4669 | SEQ ID NO: 4661 | SEQ ID NO: 4691 | SEQ ID NO: 4688 | SEQ ID NO: 4694 | |
| 20-15 | SEQ ID NO: 4669 | SEQ ID NO: 4662 | SEQ ID NO: 4691 | SEQ ID NO: 4689 | SEQ ID NO: 4694 | |
| 20-16 | SEQ ID NO: 4668 | SEQ ID NO: 4659 | SEQ ID NO: 4690 | SEQ ID NO: 4686 | | SEQ ID NO: 4670 |
| 20-17 | SEQ ID NO: 4669 | SEQ ID NO: 4661 | SEQ ID NO: 4691 | SEQ ID NO: 4688 | | SEQ ID NO: 4671 |
| 20-18 | SEQ ID NO: 4669 | SEQ ID NO: 4662 | SEQ ID NO: 4691 | SEQ ID NO: 4689 | | SEQ ID NO: 4671 |
| 20-19 | SEQ ID NO: 4668 | SEQ ID NO: 4672 | SEQ ID NO: 4690 | SEQ ID NO: 4686 | SEQ ID NO: 4694 | |
| 20-20 | SEQ ID NO: 4669 | SEQ ID NO: 4673 | SEQ ID NO: 4691 | SEQ ID NO: 4688 | SEQ ID NO: 4694 | |
| 20-21 | SEQ ID NO: 4669 | SEQ ID NO: 4674 | SEQ ID NO: 4691 | SEQ ID NO: 4689 | SEQ ID NO: 4694 | |
| 20-22 | SEQ ID NO: 4668 | SEQ ID NO: 4672 | SEQ ID NO: 4690 | SEQ ID NO: 4686 | | SEQ ID NO: 4670 |
| 20-23 | SEQ ID NO: 4669 | SEQ ID NO: 4673 | SEQ ID NO: 4691 | SEQ ID NO: 4688 | | SEQ ID NO: 4671 |
| 20-24 | SEQ ID NO: 4669 | SEQ ID NO: 4674 | SEQ ID NO: 4691 | SEQ ID NO: 4689 | | SEQ ID NO: 4671 |
| 20-25 | SEQ ID NO: 4675 | SEQ ID NO: 4659 | SEQ ID NO: 4692 | SEQ ID NO: 4686 | SEQ ID NO: 4694 | |
| 20-26 | SEQ ID NO: 4676 | SEQ ID NO: 4661 | SEQ ID NO: 4693 | SEQ ID NO: 4688 | SEQ ID NO: 4694 | |
| 20-27 | SEQ ID NO: 4676 | SEQ ID NO: 4662 | SEQ ID NO: 4693 | SEQ ID NO: 4689 | SEQ ID NO: 4694 | |
| 20-28 | SEQ ID NO: 4675 | SEQ ID NO: 4659 | SEQ ID NO: 4692 | SEQ ID NO: 4686 | | SEQ ID NO: 4677 |
| 20-29 | SEQ ID NO: 4676 | SEQ ID NO: 4661 | SEQ ID NO: 4693 | SEQ ID NO: 4688 | | SEQ ID NO: 4678 |
| 20-30 | SEQ ID NO: 4676 | SEQ ID NO: 4662 | SEQ ID NO: 4693 | SEQ ID NO: 4689 | | SEQ ID NO: 4678 |
| 20-31 | SEQ ID NO: 4675 | SEQ ID NO: 4679 | SEQ ID NO: 4692 | SEQ ID NO: 4686 | SEQ ID NO: 4694 | |
| 20-32 | SEQ ID NO: 4676 | SEQ ID NO: 4680 | SEQ ID NO: 4693 | SEQ ID NO: 4688 | SEQ ID NO: 4694 | |
| 20-33 | SEQ ID NO: 4676 | SEQ ID NO: 4681 | SEQ ID NO: 4693 | SEQ ID NO: 4689 | SEQ ID NO: 4694 | |
| 20-34 | SEQ ID NO: 4675 | SEQ ID NO: 4679 | SEQ ID NO: 4692 | SEQ ID NO: 4686 | | SEQ ID NO: 4677 |
| 20-35 | SEQ ID NO: 4676 | SEQ ID NO: 4680 | SEQ ID NO: 4693 | SEQ ID NO: 4688 | | SEQ ID NO: 4678 |
| 20-36 | SEQ ID NO: 4676 | SEQ ID NO: 4681 | SEQ ID NO: 4693 | SEQ ID NO: 4689 | | SEQ ID NO: 4678 |
| 20-37 | SEQ ID NO: 4658 | SEQ ID NO: 4682 | SEQ ID NO: 4685 | SEQ ID NO: 4686 | | |
| 20-38 | SEQ ID NO: 4660 | SEQ ID NO: 4683 | SEQ ID NO: 4687 | SEQ ID NO: 4688 | | |
| 20-39 | SEQ ID NO: 4660 | SEQ ID NO: 4684 | SEQ ID NO: 4687 | SEQ ID NO: 4689 | | |
| 20-40 | SEQ ID NO: 4668 | SEQ ID NO: 4682 | SEQ ID NO: 4690 | SEQ ID NO: 4686 | | |
| 20-41 | SEQ ID NO: 4669 | SEQ ID NO: 4683 | SEQ ID NO: 4691 | SEQ ID NO: 4688 | | |
| 20-42 | SEQ ID NO: 4669 | SEQ ID NO: 4684 | SEQ ID NO: 4691 | SEQ ID NO: 4689 | | |
| 20-43 | SEQ ID NO: 4675 | SEQ ID NO: 4682 | SEQ ID NO: 4692 | SEQ ID NO: 4686 | | |
| 20-44 | SEQ ID NO: 4676 | SEQ ID NO: 4683 | SEQ ID NO: 4693 | SEQ ID NO: 4688 | | |
| 20-45 | SEQ ID NO: 4676 | SEQ ID NO: 4684 | SEQ ID NO: 4693 | SEQ ID NO: 4689 | | |

TABLE 51

| Protein ID | D1-Fc | D5-Fab | D4-Fab | D3-Fab | D6-Fab | D2-Fab | D2-Fc |
|---|---|---|---|---|---|---|---|
| 20-01 | L234A/L235A/P329G | | Rituximab | Rituximab | SP34 | | L234A/L235A/P329G |
| 20-02 | L234A/L235A/P329G | | Rituximab | Rituximab | SP34 | | L234A/L235A/P329G |
| 20-03 | L234A/L235A/P329G | | Rituximab | Rituximab | SP34 | | L234A/L235A/P329G |
| 20-04 | L234A/L235A/P329G | Rituximab | Rituximab | Rituximab | SP34 | | L234A/L235A/P329G |
| 20-05 | L234A/L235A/P329G | Rituximab | Rituximab | Rituximab | SP34 | | L234A/L235A/P329G |
| 20-06 | L234A/L235A/P329G | Rituximab | Rituximab | Rituximab | SP34 | | L234A/L235A/P329G |
| 20-07 | L234A/L235A/P329G | | Rituximab | Rituximab | | SP34 | |
| 20-08 | L234A/L235A/P329G | | Rituximab | Rituximab | | SP34 | |
| 20-09 | L234A/L235A/P329G | | Rituximab | Rituximab | | SP34 | |
| 20-10 | L234A/L235A/P329G | Rituximab | Rituximab | Rituximab | | SP34 | |
| 20-11 | L234A/L235A/P329G | Rituximab | Rituximab | Rituximab | | SP34 | |
| 20-12 | L234A/L235A/P329G | Rituximab | Rituximab | Rituximab | | SP34 | |
| 20-13 | L234A/L235A/P329G | | FMC63 | FMC63 | SP34 | | L234A/L235A/P329G |
| 20-14 | L234A/L235A/P329G | | FMC63 | FMC63 | SP34 | | L234A/L235A/P329G |
| 20-15 | L234A/L235A/P329G | | FMC63 | FMC63 | SP34 | | L234A/L235A/P329G |
| 20-16 | L234A/L235A/P329G | FMC63 | FMC63 | FMC63 | SP34 | | L234A/L235A/P329G |
| 20-17 | L234A/L235A/P329G | FMC63 | FMC63 | FMC63 | SP34 | | L234A/L235A/P329G |
| 20-18 | L234A/L235A/P329G | FMC63 | FMC63 | FMC63 | SP34 | | L234A/L235A/P329G |
| 20-19 | L234A/L235A/P329G | | FMC63 | FMC63 | | SP34 | |
| 20-20 | L234A/L235A/P329G | | FMC63 | FMC63 | | SP34 | |
| 20-21 | L234A/L235A/P329G | | FMC63 | FMC63 | | SP34 | |
| 20-22 | L234A/L235A/P329G | FMC63 | FMC63 | FMC63 | | SP34 | |

TABLE 51-continued

| Protein ID | D1-Fc | D5-Fab | D4-Fab | D3-Fab | D6-Fab | D2-Fab | D2-Fc |
|---|---|---|---|---|---|---|---|
| 20-23 | L234A/L235A/P329G | FMC63 | FMC63 | FMC63 | | SP34 | |
| 20-24 | L234A/L235A/P329G | FMC63 | FMC63 | FMC63 | | SP34 | |
| 20-25 | L234A/L235A/P329G | | Obinutuzumab | Obinutuzumab | SP34 | | L234A/L235A/P329G |
| 20-26 | L234A/L235A/P329G | | Obinutuzumab | Obinutuzumab | SP34 | | L234A/L235A/P329G |
| 20-27 | L234A/L235A/P329G | | Obinutuzumab | Obinutuzumab | SP34 | | L234A/L235A/P329G |
| 20-28 | L234A/L235A/P329G | Obinutuzumab | Obinutuzumab | Obinutuzumab | SP34 | | L234A/L235A/P329G |
| 20-29 | L234A/L235A/P329G | Obinutuzumab | Obinutuzumab | Obinutuzumab | SP34 | | L234A/L235A/P329G |
| 20-30 | L234A/L235A/P329G | Obinutuzumab | Obinutuzumab | Obinutuzumab | SP34 | | L234A/L235A/P329G |
| 20-31 | L234A/L235A/P329G | | Obinutuzumab | Obinutuzumab | | SP34 | |
| 20-32 | L234A/L235A/P329G | | Obinutuzumab | Obinutuzumab | | SP34 | |
| 20-33 | L234A/L235A/P329G | | Obinutuzumab | Obinutuzumab | | SP34 | |
| 20-34 | L234A/L235A/P329G | Obinutuzumab | Obinutuzumab | Obinutuzumab | | SP34 | |
| 20-35 | L234A/L235A/P329G | Obinutuzumab | Obinutuzumab | Obinutuzumab | | SP34 | |
| 20-36 | L234A/L235A/P329G | Obinutuzumab | Obinutuzumab | Obinutuzumab | | SP34 | |
| 20-37 | L234A/L235A/P329G | SP34 | Rituximab | Rituximab | SP34 | | L234A/L235A/P329G |
| 20-38 | L234A/L235A/P329G | SP34 | Rituximab | Rituximab | SP34 | | L234A/L235A/P329G |
| 20-39 | L234A/L235A/P329G | SP34 | Rituximab | Rituximab | SP34 | | L234A/L235A/P329G |
| 20-40 | L234A/L235A/P329G | SP34 | FMC63 | FMC63 | SP34 | | L234A/L235A/P329G |
| 20-41 | L234A/L235A/P329G | SP34 | FMC63 | FMC63 | SP34 | | L234A/L235A/P329G |
| 20-42 | L234A/L235A/P329G | SP34 | FMC63 | FMC63 | SP34 | | L234A/L235A/P329G |
| 20-43 | L234A/L235A/P329G | SP34 | Obinutuzumab | Obinutuzumab | SP34 | | L234A/L235A/P329G |
| 20-44 | L234A/L235A/P329G | SP34 | Obinutuzumab | Obinutuzumab | SP34 | | L234A/L235A/P329G |
| 20-45 | L234A/L235A/P329G | SP34 | Obinutuzumab | Obinutuzumab | SP34 | | L234A/L235A/P329G |

TABLE 52

| Protein ID | D1-Fc Specificity | D5-Fab Specificity | D4-Fab Specificity | D3-Fab Specificity | D6-Fab Specificity | D2-Fab Specificity | D2-Fc Specificity |
|---|---|---|---|---|---|---|---|
| 20-01 | FcgR silent | | CD20 | CD20 | CD3 | | FcgR silent |
| 20-02 | FcgR silent | | CD20 | CD20 | CD3 | | FcgR silent |
| 20-03 | FcgR silent | | CD20 | CD20 | CD3 | | FcgR silent |
| 20-04 | FcgR silent | CD20 | CD20 | CD20 | CD3 | | FcgR silent |
| 20-05 | FcgR silent | CD20 | CD20 | CD20 | CD3 | | FcgR silent |
| 20-06 | FcgR silent | CD20 | CD20 | CD20 | CD3 | | FcgR silent |
| 20-07 | FcgR silent | | CD20 | CD20 | | CD3 | |
| 20-08 | FcgR silent | | CD20 | CD20 | | CD3 | |
| 20-09 | FcgR silent | | CD20 | CD20 | | CD3 | |
| 20-10 | FcgR silent | CD20 | CD20 | CD20 | | CD3 | |
| 20-11 | FcgR silent | CD20 | CD20 | CD20 | | CD3 | |
| 20-12 | FcgR silent | CD20 | CD20 | CD20 | | CD3 | |
| 20-13 | FcgR silent | | CD19 | CD19 | | CD3 | FcgR silent |
| 20-14 | FcgR silent | | CD19 | CD19 | CD3 | | FcgR silent |
| 20-15 | FcgR silent | | CD19 | CD19 | CD3 | | FcgR silent |
| 20-16 | FcgR silent | CD19 | CD19 | CD19 | CD3 | | FcgR silent |
| 20-17 | FcgR silent | CD19 | CD19 | CD19 | CD3 | | FcgR silent |
| 20-18 | FcgR silent | CD19 | CD19 | CD19 | CD3 | | FcgR silent |
| 20-19 | FcgR silent | | CD19 | CD19 | | CD3 | |
| 20-20 | FcgR silent | | CD19 | CD19 | | CD3 | |
| 20-21 | FcgR silent | | CD19 | CD19 | | CD3 | |
| 20-22 | FcgR silent | CD19 | CD19 | CD19 | | CD3 | |
| 20-23 | FcgR silent | CD19 | CD19 | CD19 | | CD3 | |
| 20-24 | FcgR silent | CD19 | CD19 | CD19 | | CD3 | |
| 20-25 | FcgR silent | | CD20 | CD20 | CD3 | | FcgR silent |
| 20-26 | FcgR silent | | CD20 | CD20 | CD3 | | FcgR silent |
| 20-27 | FcgR silent | | CD20 | CD20 | CD3 | | FcgR silent |
| 20-28 | FcgR silent | CD20 | CD20 | CD20 | CD3 | | FcgR silent |
| 20-29 | FcgR silent | CD20 | CD20 | CD20 | CD3 | | FcgR silent |
| 20-30 | FcgR silent | CD20 | CD20 | CD20 | CD3 | | FcgR silent |
| 20-31 | FcgR silent | | CD20 | CD20 | | CD3 | |
| 20-32 | FcgR silent | | CD20 | CD20 | | CD3 | |
| 20-33 | FcgR silent | | CD20 | CD20 | | CD3 | |
| 20-34 | FcgR silent | CD20 | CD20 | CD20 | | CD3 | |
| 20-35 | FcgR silent | CD20 | CD20 | CD20 | | CD3 | |
| 20-36 | FcgR silent | CD20 | CD20 | CD20 | | CD3 | |
| 20-37 | FcgR silent | CD3 | CD20 | CD20 | CD3 | | FcgR silent |
| 20-38 | FcgR silent | CD3 | CD20 | CD20 | CD3 | | FcgR silent |
| 20-39 | FcgR silent | CD3 | CD20 | CD20 | CD3 | | FcgR silent |
| 20-40 | FcgR silent | CD3 | CD19 | CD19 | CD3 | | FcgR silent |
| 20-41 | FcgR silent | CD3 | CD19 | CD19 | CD3 | | FcgR silent |

TABLE 52-continued

| Protein ID | D1-Fc Specificity | D5-Fab Specificity | D4-Fab Specificity | D3-Fab Specificity | D6-Fab Specificity | D2-Fab Specificity | D2-Fc Specificity |
|---|---|---|---|---|---|---|---|
| 20-42 | FcgR silent | CD3 | CD19 | CD19 | CD3 | | FcgR silent |
| 20-43 | FcgR silent | CD3 | CD20 | CD20 | CD3 | | FcgR silent |
| 20-44 | FcgR silent | CD3 | CD20 | CD20 | CD3 | | FcgR silent |
| 20-45 | FcgR silent | CD3 | CD20 | CD20 | CD3 | | FcgR silent |

TABLE 53

| | H1/H3 Chain | | H2 Chain | | L1 Chain | | L2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 20-01 | VH-CH1 | K147E/K213E (H1 only) | VK-CH1 | | VK-CK | E123R/Q124K | VH-CK | |
| 20-02 | VH-CH1 | Q39K/S183E (H1 only) | VK-CH1 | Q38E/S183K | VK-CK | Q38E/V133K | VH-CK | Q39K/V133E |
| 20-03 | VH-CH1 | Q39K/S183E (H1 only) | VK-CH1 | Q38K/S183K | VK-CK | Q38E/V133K | VH-CK | Q39E/V133E |
| 20-04 | VH-CH1 | K147E/K213E | VK-CH1 | | VK-CK | E123R/Q124K | VH-CK | |
| 20-05 | VH-CH1 | Q39K/S183E | VK-CH1 | Q38E/S183K | VK-CK | Q38E/V133K | VH-CK | Q39K/V133E |
| 20-06 | VH-CH1 | Q39K/S183E | VK-CH1 | Q38K/S183K | VK-CK | Q38E/V133K | VH-CK | Q39E/V133E |
| 20-07 | VH-CH1 | K147E/K213E (H1 only) | VH-CH1 VK-CH1 | K147E/K213E | VK-CK | E123R/Q124K | VH-CK | |
| 20-08 | VH-CH1 | Q39K/S183E (H1 only) | VH-CH1 VK-CH1 | Q39K/S183E Q38E/S183K | VK-CK | Q38E/V133K | VH-CK | Q39K/V133E |
| 20-09 | VH-CH1 | Q39K/S183E (H1 only) | VH-CH1 VK-CH1 | Q39K/S183E Q38K/S183K | VK-CK | Q38E/V133K | VH-CK | Q39E/V133E |
| 20-10 | VH-CH1 | K147E/K213E | VH-CH1 VK-CH1 | K147E/K213E | VK-CK | E123R/Q124K | VH-CK | |
| 20-11 | VH-CH1 | Q39K/S183E | VH-CH1 VK-CH1 | Q39K/S183E Q38E/S183K | VK-CK | Q38E/V133K | VH-CK | Q39K/V133E |
| 20-12 | VH-CH1 | Q39K/S183E | VH-CH1 VK-CH1 | Q39K/S183E Q38K/S183K | VK-CK | Q38E/V133K | VH-CK | Q39E/V133E |
| 20-13 | VH-CH1 | K147E/K213E (H1 only) | VK-CH1 | | VK-CK | E123R/Q124K | VH-CK | |
| 20-14 | VH-CH1 | Q39K/S183E (H1 only) | VK-CH1 | Q38E/S183K | VK-CK | Q38E/V133K | VH-CK | Q39K/V133E |
| 20-15 | VH-CH1 | Q39K/S183E (H1 only) | VK-CH1 | Q38K/S183K | VK-CK | Q38E/V133K | VH-CK | Q39E/V133E |
| 20-16 | VH-CH1 | K147E/K213E | VK-CH1 | | VK-CK | E123R/Q124K | VH-CK | |
| 20-17 | VH-CH1 | Q39K/S183E | VK-CH1 | Q38E/S183K | VK-CK | Q38E/V133K | VH-CK | Q39K/V133E |
| 20-18 | VH-CH1 | Q39K/S183E | VK-CH1 | Q38K/S183K | VK-CK | Q38E/V133K | VH-CK | Q39E/V133E |
| 20-19 | VH-CH1 | K147E/K213E (H1 only) | VH-CH1 VK-CH1 | K147E/K213E | VK-CK | E123R/Q124K | VH-CK | |
| 20-20 | VH-CH1 | Q39K/S183E (H1 only) | VH-CH1 VK-CH1 | Q39K/S183E Q38E/S183K | VK-CK | Q38E/V133K | VH-CK | Q39K/V133E |
| 20-21 | VH-CH1 | Q39K/S183E (H1 only) | VH-CH1 VK-CH1 | Q39K/S183E Q38K/S183K | VK-CK | Q38E/V133K | VH-CK | Q39E/V133E |
| 20-22 | VH-CH1 | K147E/K213E | VH-CH1 VK-CH1 | K147E/K213E | VK-CK | E123R/Q124K | VH-CK | |
| 20-23 | VH-CH1 | Q39K/S183E | VH-CH1 VK-CH1 | Q39K/S183E Q38E/S183K | VK-CK | Q38E/V133K | VH-CK | Q39K/V133E |
| 20-24 | VH-CH1 | Q39K/S183E | VH-CH1 VK-CH1 | Q39K/S183E Q38K/S183K | VK-CK | Q38E/V133K | VH-CK | Q39E/V133E |
| 20-25 | VH-CH1 | K147E/K213E (H1 only) | VK-CH1 | | VK-CK | E123R/Q124K | VH-CK | |
| 20-26 | VH-CH1 | Q39K/S183E (H1 only) | VK-CH1 | Q38E/S183K | VK-CK | Q38E/V133K | VH-CK | Q39K/V133E |
| 20-27 | VH-CH1 | Q39K/S183E (H1 only) | VK-CH1 | Q38K/S183K | VK-CK | Q38E/V133K | VH-CK | Q39E/V133E |
| 20-28 | VH-CH1 | K147E/K213E | VK-CH1 | | VK-CK | E123R/Q124K | VH-CK | |
| 20-29 | VH-CH1 | Q39K/S183E | VK-CH1 | Q38E/S183K | VK-CK | Q38E/V133K | VH-CK | Q39K/V133E |
| 20-30 | VH-CH1 | Q39K/S183E | VK-CH1 | Q38K/S183K | VK-CK | Q38E/V133K | VH-CK | Q39E/V133E |
| 20-31 | VH-CH1 | K147E/K213E (H1 only) | VH-CH1 VK-CH1 | K147E/K213E | VK-CK | E123R/Q124K | VH-CK | |
| 20-32 | VH-CH1 | Q39K/S183E (H1 only) | VH-CH1 VK-CH1 | Q39K/S183E Q38E/S183K | VK-CK | Q38E/V133K | VH-CK | Q39K/V133E |
| 20-33 | VH-CH1 | Q39K/S183E (H1 only) | VH-CH1 VK-CH1 | Q39K/S183E Q38K/S183K | VK-CK | Q38E/V133K | VH-CK | Q39E/V133E |
| 20-34 | VH-CH1 | K147E/K213E | VH-CH1 VK-CH1 | K147E/K213E | VK-CK | E123R/Q124K | VH-CK | |
| 20-35 | VH-CH1 | Q39K/S183E | VH-CH1 VK-CH1 | Q39K/S183E Q38E/S183K | VK-CK | Q38E/V133K | VH-CK | Q39K/V133E |

TABLE 53-continued

| Protein ID | H1/H3 Chain V region type | H1/H3 Chain Amino acid Substitutions | H2 Chain V region Type | H2 Chain Amino acid Substitutions | L1 Chain V region Type | L1 Chain Amino acid Substitutions | L2 Chain V region Type | L2 Chain Amino acid Substitutions |
|---|---|---|---|---|---|---|---|---|
| 20-36 | VH-CH1 | Q39K/S183E | VH-CH1<br>VK-CH1 | Q39K/S183E<br>Q38K/S183K | VK-CK | Q38E/V133K | VH-CK | Q39E/V133E |
| 20-37 | VH-CH1 | K147E/K213E (H1 only) | VK-CH1 | | VK-CK | E123R/Q124K | VH-CK | |
| 20-38 | VH-CH1 | Q39K/S183E (H1 only) | VK-CH1 | Q38E/S183K | VK-CK | Q38E/V133K | VH-CK | Q39K/V133E |
| 20-39 | VH-CH1 | Q39K/S183E (H1 only) | VK-CH1 | Q38K/S183K | VK-CK | Q38E/V133K | VH-CK | Q39E/V133E |
| 20-40 | VH-CH1 | K147E/K213E (H1 only) | VK-CH1 | | VK-CK | E123R/Q124K | VH-CK | |
| 20-41 | VH-CH1 | Q39K/S183E (H1 only) | VK-CH1 | Q38E/S183K | VK-CK | Q38E/V133K | VH-CK | Q39K/V133E |
| 20-42 | VH-CH1 | Q39K/S183E (H1 only) | VK-CH1 | Q38K/S183K | VK-CK | Q38E/V133K | VH-CK | Q39E/V133E |
| 20-43 | VH-CH1 | K147E/K213E (H1 only) | VK-CH1 | | VK-CK | E123R/Q124K | VH-CK | |
| 20-44 | VH-CH1 | Q39K/S183E (H1 only) | VK-CH1 | Q38E/S183K | VK-CK | Q38E/V133K | VH-CK | Q39K/V133E |
| 20-45 | VH-CH1 | Q39K/S183E (H1 only) | VK-CH1 | Q38K/S183K | VK-CK | Q38E/V133K | VH-CK | Q39E/V133E |

Example 23—Tetravalent, Bispecific Tetrahedral Antibodies Comprising Two Distinct Fabs that Specifically Bind CD19 and CD20, and Two Fc Domains with FcgR Enhancing Mutations Tetrahedral antibodies were designed, expressed, and evaluated for their ability to co-engage NK cells and disease target cells for the treatment of B cell cancer and other B cell disease, particularly resistant and recurrent disease. This series of bispecific constructs employ VH and VL regions from rituximab (anti-CD20) and FMC63 (anti-CD19), or rituximab and either FMC60 or FMC59, two different humanized versions of FMC63. (Tables 54, 55). Two distinct configurations of the anti-CD20 and anti-CD19 Fabs were evaluated (Table 56). In the first, the anti-CD20 and anti-CD19 Fabs are placed in D3/D4 and D5/D6, respectively; in the second, the anti-CD20 and anti-CD19 Fabs are placed in D5/D6 and D3/D4, respectively. Additionally, the D1/D2 Fc domains were alternatively wild-type with respect to FcgR binding sequences or comprised the FcgR enhancing mutations S239D/I332E. Three distinct configurations of the FcgR enhancing mutations were evaluated (Tables 55, 56). In the first, the H1 and H2 chains each comprised the S239D and I332E mutations (symmetric configuration). In the second, the H1 chain comprised the S239D mutation and the H2 chain comprised the I332E mutation (asymmetric configuration). In the third, the H1 chain comprised the I332E mutation and the H2 chain comprised the S239D mutation (asymmetric configuration). To optimize correct VH/VL pairing and to minimize VH/VL mispairing, V region exchange was combined with four different sets of charge pairs to ensure correct pairing of heavy and light chain V regions (Table 57). Additionally, to further facilitate purification of the correctly paired product by Protein A chromatography, the H1 chain incorporated the H435R/Y436F substitution. The constructs are then evaluated for their structural bispecificity by intact mass spectrometry as described in Example 18, and for their functional bispecificity using a variety of in vitro binding assays, cytotoxicity assays, and cytokine induction and release assays, and in vivo cancer efficacy models, known to one skilled in the art.

TABLE 54

| Protein ID | H1 Chain | H2 Chain | L1 Chain | L2 Chain | Fc Chain |
|---|---|---|---|---|---|
| 21-01 | SEQ ID NO: 4701 | SEQ ID NO: 4702 | SEQ ID NO: 4801 | SEQ ID NO: 4802 | |
| 21-02 | SEQ ID NO: 4703 | SEQ ID NO: 4704 | SEQ ID NO: 4803 | SEQ ID NO: 4804 | |
| 21-03 | SEQ ID NO: 4703 | SEQ ID NO: 4705 | SEQ ID NO: 4803 | SEQ ID NO: 4805 | |
| 21-04 | SEQ ID NO: 4706 | SEQ ID NO: 4707 | SEQ ID NO: 4806 | SEQ ID NO: 4807 | |
| 21-05 | SEQ ID NO: 4708 | SEQ ID NO: 4709 | SEQ ID NO: 4808 | SEQ ID NO: 4809 | |
| 21-06 | SEQ ID NO: 4708 | SEQ ID NO: 4710 | SEQ ID NO: 4808 | SEQ ID NO: 4810 | |
| 21-07 | SEQ ID NO: 4711 | SEQ ID NO: 4712 | SEQ ID NO: 4801 | SEQ ID NO: 4802 | |
| 21-08 | SEQ ID NO: 4713 | SEQ ID NO: 4714 | SEQ ID NO: 4803 | SEQ ID NO: 4804 | |
| 21-09 | SEQ ID NO: 4713 | SEQ ID NO: 4715 | SEQ ID NO: 4803 | SEQ ID NO: 4805 | |
| 21-10 | SEQ ID NO: 4716 | SEQ ID NO: 4717 | SEQ ID NO: 4806 | SEQ ID NO: 4807 | |
| 21-11 | SEQ ID NO: 4718 | SEQ ID NO: 4719 | SEQ ID NO: 4808 | SEQ ID NO: 4809 | |
| 21-12 | SEQ ID NO: 4718 | SEQ ID NO: 4720 | SEQ ID NO: 4808 | SEQ ID NO: 4810 | |
| 21-13 | SEQ ID NO: 4721 | SEQ ID NO: 4722 | SEQ ID NO: 4801 | SEQ ID NO: 4802 | |
| 21-14 | SEQ ID NO: 4723 | SEQ ID NO: 4724 | SEQ ID NO: 4803 | SEQ ID NO: 4804 | |
| 21-15 | SEQ ID NO: 4723 | SEQ ID NO: 4725 | SEQ ID NO: 4803 | SEQ ID NO: 4805 | |
| 21-16 | SEQ ID NO: 4726 | SEQ ID NO: 4727 | SEQ ID NO: 4806 | SEQ ID NO: 4807 | |
| 21-17 | SEQ ID NO: 4728 | SEQ ID NO: 4729 | SEQ ID NO: 4808 | SEQ ID NO: 4809 | |
| 21-18 | SEQ ID NO: 4728 | SEQ ID NO: 4730 | SEQ ID NO: 4808 | SEQ ID NO: 4810 | |
| 21-19 | SEQ ID NO: 4731 | | SEQ ID NO: 4811 | | |
| 21-20 | SEQ ID NO: 4732 | | SEQ ID NO: 4811 | | |

TABLE 54-continued

| Protein ID | H1 Chain | H2 Chain | L1 Chain | L2 Chain | Fe Chain |
|---|---|---|---|---|---|
| 21-21 | SEQ ID NO: 4733 | SEQ ID NO: 4734 | SEQ ID NO: 4811 | | |
| 21-22 | SEQ ID NO: 4735 | SEQ ID NO: 4736 | SEQ ID NO: 4811 | | |
| 21-23 | SEQ ID NO: 4737 | SEQ ID NO: 4738 | SEQ ID NO: 4811 | | |
| 21-24 | SEQ ID NO: 4739 | SEQ ID NO: 4740 | SEQ ID NO: 4811 | | |
| 21-25 | SEQ ID NO: 4741 | | SEQ ID NO: 4812 | | |
| 21-26 | SEQ ID NO: 4742 | | SEQ ID NO: 4812 | | |
| 21-27 | SEQ ID NO: 4743 | SEQ ID NO: 4744 | SEQ ID NO: 4812 | | |
| 21-28 | SEQ ID NO: 4745 | SEQ ID NO: 4746 | SEQ ID NO: 4812 | | |
| 21-29 | SEQ ID NO: 4747 | SEQ ID NO: 4748 | SEQ ID NO: 4812 | | |
| 21-30 | SEQ ID NO: 4749 | SEQ ID NO: 4750 | SEQ ID NO: 4812 | | |
| 21-31 | SEQ ID NO: 4695 | SEQ ID NO: 4751 | SEQ ID NO: 4803 | SEQ ID NO: 4813 | |
| 21-32 | SEQ ID NO: 4695 | SEQ ID NO: 4752 | SEQ ID NO: 4803 | SEQ ID NO: 4814 | |
| 21-33 | SEQ ID NO: 4753 | SEQ ID NO: 4751 | SEQ ID NO: 4815 | SEQ ID NO: 4813 | |
| 21-34 | SEQ ID NO: 4753 | SEQ ID NO: 4752 | SEQ ID NO: 4815 | SEQ ID NO: 4814 | |
| 21-35 | SEQ ID NO: 4754 | SEQ ID NO: 4699 | SEQ ID NO: 4816 | SEQ ID NO: 4809 | |
| 21-36 | SEQ ID NO: 4754 | SEQ ID NO: 4700 | SEQ ID NO: 4816 | SEQ ID NO: 4810 | |
| 21-37 | SEQ ID NO: 4755 | SEQ ID NO: 4699 | SEQ ID NO: 4817 | SEQ ID NO: 4809 | |
| 21-38 | SEQ ID NO: 4755 | SEQ ID NO: 4700 | SEQ ID NO: 4817 | SEQ ID NO: 4810 | |
| 21-39 | SEQ ID NO: 4756 | SEQ ID NO: 4757 | SEQ ID NO: 4803 | SEQ ID NO: 4813 | |
| 21-40 | SEQ ID NO: 4756 | SEQ ID NO: 4758 | SEQ ID NO: 4803 | SEQ ID NO: 4814 | |
| 21-41 | SEQ ID NO: 4759 | SEQ ID NO: 4757 | SEQ ID NO: 4815 | SEQ ID NO: 4813 | |
| 21-42 | SEQ ID NO: 4759 | SEQ ID NO: 4758 | SEQ ID NO: 4815 | SEQ ID NO: 4814 | |
| 21-43 | SEQ ID NO: 4760 | SEQ ID NO: 4761 | SEQ ID NO: 4816 | SEQ ID NO: 4809 | |
| 21-44 | SEQ ID NO: 4760 | SEQ ID NO: 4762 | SEQ ID NO: 4816 | SEQ ID NO: 4810 | |
| 21-45 | SEQ ID NO: 4763 | SEQ ID NO: 4761 | SEQ ID NO: 4817 | SEQ ID NO: 4809 | |
| 21-46 | SEQ ID NO: 4763 | SEQ ID NO: 4762 | SEQ ID NO: 4817 | SEQ ID NO: 4810 | |
| 21-47 | SEQ ID NO: 4764 | SEQ ID NO: 4765 | SEQ ID NO: 4803 | SEQ ID NO: 4813 | |
| 21-48 | SEQ ID NO: 4764 | SEQ ID NO: 4766 | SEQ ID NO: 4803 | SEQ ID NO: 4814 | |
| 21-49 | SEQ ID NO: 4767 | SEQ ID NO: 4765 | SEQ ID NO: 4815 | SEQ ID NO: 4813 | |
| 21-50 | SEQ ID NO: 4767 | SEQ ID NO: 4766 | SEQ ID NO: 4815 | SEQ ID NO: 4814 | |
| 21-51 | SEQ ID NO: 4768 | SEQ ID NO: 4769 | SEQ ID NO: 4816 | SEQ ID NO: 4809 | |
| 21-52 | SEQ ID NO: 4768 | SEQ ID NO: 4770 | SEQ ID NO: 4816 | SEQ ID NO: 4810 | |
| 21-53 | SEQ ID NO: 4771 | SEQ ID NO: 4769 | SEQ ID NO: 4817 | SEQ ID NO: 4809 | |
| 21-54 | SEQ ID NO: 4771 | SEQ ID NO: 4770 | SEQ ID NO: 4817 | SEQ ID NO: 4810 | |
| 21-55 | SEQ ID NO: 4723 | SEQ ID NO: 4772 | SEQ ID NO: 4803 | SEQ ID NO: 4813 | |
| 21-56 | SEQ ID NO: 4723 | SEQ ID NO: 4773 | SEQ ID NO: 4803 | SEQ ID NO: 4814 | |
| 21-57 | SEQ ID NO: 4774 | SEQ ID NO: 4772 | SEQ ID NO: 4815 | SEQ ID NO: 4813 | |
| 21-58 | SEQ ID NO: 4774 | SEQ ID NO: 4773 | SEQ ID NO: 4815 | SEQ ID NO: 4814 | |
| 21-59 | SEQ ID NO: 4775 | SEQ ID NO: 4729 | SEQ ID NO: 4816 | SEQ ID NO: 4809 | |
| 21-60 | SEQ ID NO: 4775 | SEQ ID NO: 4730 | SEQ ID NO: 4816 | SEQ ID NO: 4810 | |
| 21-61 | SEQ ID NO: 4776 | SEQ ID NO: 4729 | SEQ ID NO: 4817 | SEQ ID NO: 4809 | |
| 21-62 | SEQ ID NO: 4776 | SEQ ID NO: 4730 | SEQ ID NO: 4817 | SEQ ID NO: 4810 | |
| 21-63 | SEQ ID NO: 4777 | | SEQ ID NO: 4818 | | |
| 21-64 | SEQ ID NO: 4778 | | SEQ ID NO: 4818 | | |
| 21-65 | SEQ ID NO: 4779 | SEQ ID NO: 4780 | SEQ ID NO: 4818 | | |
| 21-66 | SEQ ID NO: 4781 | SEQ ID NO: 4782 | SEQ ID NO: 4818 | | |
| 21-67 | SEQ ID NO: 4783 | SEQ ID NO: 4784 | SEQ ID NO: 4818 | | |
| 21-68 | SEQ ID NO: 4785 | SEQ ID NO: 4786 | SEQ ID NO: 4818 | | |
| 21-69 | SEQ ID NO: 4695 | SEQ ID NO: 4787 | SEQ ID NO: 4803 | SEQ ID NO: 4813 | |
| 21-70 | SEQ ID NO: 4695 | SEQ ID NO: 4788 | SEQ ID NO: 4803 | SEQ ID NO: 4814 | |
| 21-71 | SEQ ID NO: 4753 | SEQ ID NO: 4787 | SEQ ID NO: 4815 | SEQ ID NO: 4813 | |
| 21-72 | SEQ ID NO: 4753 | SEQ ID NO: 4788 | SEQ ID NO: 4815 | SEQ ID NO: 4814 | |
| 21-73 | SEQ ID NO: 4754 | SEQ ID NO: 4699 | SEQ ID NO: 4819 | SEQ ID NO: 4809 | |
| 21-74 | SEQ ID NO: 4754 | SEQ ID NO: 4700 | SEQ ID NO: 4819 | SEQ ID NO: 4810 | |
| 21-75 | SEQ ID NO: 4755 | SEQ ID NO: 4699 | SEQ ID NO: 4820 | SEQ ID NO: 4809 | |
| 21-76 | SEQ ID NO: 4755 | SEQ ID NO: 4700 | SEQ ID NO: 4820 | SEQ ID NO: 4810 | |
| 21-77 | SEQ ID NO: 4756 | SEQ ID NO: 4789 | SEQ ID NO: 4803 | SEQ ID NO: 4813 | |
| 21-78 | SEQ ID NO: 4756 | SEQ ID NO: 4790 | SEQ ID NO: 4803 | SEQ ID NO: 4814 | |
| 21-79 | SEQ ID NO: 4759 | SEQ ID NO: 4789 | SEQ ID NO: 4815 | SEQ ID NO: 4813 | |
| 21-80 | SEQ ID NO: 4759 | SEQ ID NO: 4790 | SEQ ID NO: 4815 | SEQ ID NO: 4814 | |
| 21-81 | SEQ ID NO: 4760 | SEQ ID NO: 4761 | SEQ ID NO: 4819 | SEQ ID NO: 4809 | |
| 21-82 | SEQ ID NO: 4760 | SEQ ID NO: 4762 | SEQ ID NO: 4819 | SEQ ID NO: 4810 | |
| 21-83 | SEQ ID NO: 4763 | SEQ ID NO: 4761 | SEQ ID NO: 4820 | SEQ ID NO: 4809 | |
| 21-84 | SEQ ID NO: 4763 | SEQ ID NO: 4762 | SEQ ID NO: 4820 | SEQ ID NO: 4810 | |
| 21-85 | SEQ ID NO: 4764 | SEQ ID NO: 4791 | SEQ ID NO: 4803 | SEQ ID NO: 4813 | |
| 21-86 | SEQ ID NO: 4764 | SEQ ID NO: 4792 | SEQ ID NO: 4803 | SEQ ID NO: 4814 | |
| 21-87 | SEQ ID NO: 4767 | SEQ ID NO: 4791 | SEQ ID NO: 4815 | SEQ ID NO: 4813 | |
| 21-88 | SEQ ID NO: 4767 | SEQ ID NO: 4792 | SEQ ID NO: 4815 | SEQ ID NO: 4814 | |
| 21-89 | SEQ ID NO: 4768 | SEQ ID NO: 4769 | SEQ ID NO: 4819 | SEQ ID NO: 4809 | |
| 21-90 | SEQ ID NO: 4768 | SEQ ID NO: 4770 | SEQ ID NO: 4819 | SEQ ID NO: 4810 | |
| 21-91 | SEQ ID NO: 4771 | SEQ ID NO: 4769 | SEQ ID NO: 4820 | SEQ ID NO: 4809 | |
| 21-92 | SEQ ID NO: 4771 | SEQ ID NO: 4770 | SEQ ID NO: 4820 | SEQ ID NO: 4810 | |
| 21-93 | SEQ ID NO: 4723 | SEQ ID NO: 4793 | SEQ ID NO: 4803 | SEQ ID NO: 4813 | |
| 21-94 | SEQ ID NO: 4723 | SEQ ID NO: 4794 | SEQ ID NO: 4803 | SEQ ID NO: 4814 | |
| 21-95 | SEQ ID NO: 4774 | SEQ ID NO: 4793 | SEQ ID NO: 4815 | SEQ ID NO: 4813 | |
| 21-96 | SEQ ID NO: 4774 | SEQ ID NO: 4794 | SEQ ID NO: 4815 | SEQ ID NO: 4814 | |
| 21-97 | SEQ ID NO: 4775 | SEQ ID NO: 4729 | SEQ ID NO: 4819 | SEQ ID NO: 4809 | |

TABLE 54-continued

| Protein ID | H1 Chain | H2 Chain | L1 Chain | L2 Chain | Fc Chain |
|---|---|---|---|---|---|
| 21-98 | SEQ ID NO: 4775 | SEQ ID NO: 4730 | SEQ ID NO: 4819 | SEQ ID NO: 4810 | |
| 21-99 | SEQ ID NO: 4776 | SEQ ID NO: 4729 | SEQ ID NO: 4820 | SEQ ID NO: 4809 | |
| 21-100 | SEQ ID NO: 4776 | SEQ ID NO: 4730 | SEQ ID NO: 4820 | SEQ ID NO: 4810 | |
| 21-101 | SEQ ID NO: 4777 | | SEQ ID NO: 4821 | | |
| 21-102 | SEQ ID NO: 4778 | | SEQ ID NO: 4821 | | |
| 21-103 | SEQ ID NO: 4779 | SEQ ID NO: 4780 | SEQ ID NO: 4821 | | |
| 21-104 | SEQ ID NO: 4781 | SEQ ID NO: 4782 | SEQ ID NO: 4821 | | |
| 21-105 | SEQ ID NO: 4783 | SEQ ID NO: 4784 | SEQ ID NO: 4821 | | |
| 21-106 | SEQ ID NO: 4785 | SEQ ID NO: 4786 | SEQ ID NO: 4821 | | |
| 21-107 | SEQ ID NO: 4695 | SEQ ID NO: 4799 | SEQ ID NO: 4803 | SEQ ID NO: 4826 | |
| 21-108 | SEQ ID NO: 4695 | SEQ ID NO: 4800 | SEQ ID NO: 4803 | SEQ ID NO: 4827 | |
| 21-109 | SEQ ID NO: 4698 | SEQ ID NO: 4799 | SEQ ID NO: 4808 | SEQ ID NO: 4826 | |
| 21-110 | SEQ ID NO: 4698 | SEQ ID NO: 4800 | SEQ ID NO: 4808 | SEQ ID NO: 4827 | |
| 21-111 | SEQ ID NO: 4795 | SEQ ID NO: 4699 | SEQ ID NO: 4822 | SEQ ID NO: 4809 | |
| 21-112 | SEQ ID NO: 4795 | SEQ ID NO: 4700 | SEQ ID NO: 4822 | SEQ ID NO: 4810 | |
| 21-113 | SEQ ID NO: 4795 | SEQ ID NO: 4696 | SEQ ID NO: 4822 | SEQ ID NO: 4804 | |
| 21-114 | SEQ ID NO: 4795 | SEQ ID NO: 4697 | SEQ ID NO: 4822 | SEQ ID NO: 4805 | |
| 21-115 | SEQ ID NO: 4695 | SEQ ID NO: 4796 | SEQ ID NO: 4803 | SEQ ID NO: 4823 | |
| 21-116 | SEQ ID NO: 4695 | SEQ ID NO: 4797 | SEQ ID NO: 4803 | SEQ ID NO: 4824 | |
| 21-117 | SEQ ID NO: 4698 | SEQ ID NO: 4796 | SEQ ID NO: 4808 | SEQ ID NO: 4823 | |
| 21-118 | SEQ ID NO: 4698 | SEQ ID NO: 4797 | SEQ ID NO: 4808 | SEQ ID NO: 4824 | |
| 21-119 | SEQ ID NO: 4798 | SEQ ID NO: 4699 | SEQ ID NO: 4825 | SEQ ID NO: 4809 | |
| 21-120 | SEQ ID NO: 4798 | SEQ ID NO: 4700 | SEQ ID NO: 4825 | SEQ ID NO: 4810 | |
| 21-121 | SEQ ID NO: 4798 | SEQ ID NO: 4696 | SEQ ID NO: 4825 | SEQ ID NO: 4804 | |
| 21-122 | SEQ ID NO: 4798 | SEQ ID NO: 4697 | SEQ ID NO: 4825 | SEQ ID NO: 4805 | |
| 21-123 | SEQ ID NO: 4733 | | SEQ ID NO: 4811 | | SEQ ID NO: 4828 |
| 21-124 | SEQ ID NO: 4743 | | SEQ ID NO: 4812 | | SEQ ID NO: 4828 |
| 21-125 | SEQ ID NO: 4779 | | SEQ ID NO: 4818 | | SEQ ID NO: 4828 |
| 21-126 | SEQ ID NO: 4779 | | SEQ ID NO: 4821 | | SEQ ID NO: 4828 |
| 21-127 | SEQ ID NO: 4739 | | SEQ ID NO: 4811 | | SEQ ID NO: 4829 |
| 21-128 | SEQ ID NO: 4749 | | SEQ ID NO: 4812 | | SEQ ID NO: 4829 |
| 21-129 | SEQ ID NO: 4785 | | SEQ ID NO: 4818 | | SEQ ID NO: 4829 |
| 21-130 | SEQ ID NO: 4785 | | SEQ ID NO: 4821 | | SEQ ID NO: 4829 |

TABLE 55

| Protein ID | D1-Fc | D5-Fab | D4-Fab | D3-Fab | D6-Fab | D2-Fc | Other |
|---|---|---|---|---|---|---|---|
| 21-01 | S239D (H1), I298E (H2) | FMC63 | Rituximab | Rituximab | FMC63 | S239D (H1), I298E (H2) | |
| 21-02 | S239D (H1), I298E (H2) | FMC63 | Rituximab | Rituximab | FMC63 | S239D (H1), I298E (H2) | |
| 21-03 | S239D (H1), I298E (H2) | FMC63 | Rituximab | Rituximab | FMC63 | S239D (H1), I298E (H2) | |
| 21-04 | S239D (H1), I298E (H2) | Rituximab | FMC63 | FMC63 | Rituximab | S239D (H1), I298E (H2) | |
| 21-05 | S239D (H1), I298E (H2) | Rituximab | FMC63 | FMC63 | Rituximab | S239D (H1), I298E (H2) | |
| 21-06 | S239D (H1), I298E (H2) | Rituximab | FMC63 | FMC63 | Rituximab | S239D (H1), I298E (H2) | |
| 21-07 | I298E (H1), S239D (H2) | FMC63 | Rituximab | Rituximab | FMC63 | I298E (H1), S239D (H2) | |
| 21-08 | I298E (H1), S239D (H2) | FMC63 | Rituximab | Rituximab | FMC63 | I298E (H1), S239D (H2) | |
| 21-09 | I298E (H1), S239D (H2) | FMC63 | Rituximab | Rituximab | FMC63 | I298E (H1), S239D (H2) | |
| 21-10 | I298E (H1), S239D (H2) | Rituximab | FMC63 | FMC63 | Rituximab | I298E (H1), S239D (H2) | |
| 21-11 | I298E (H1), S239D (H2) | Rituximab | FMC63 | FMC63 | Rituximab | I298E (H1), S239D (H2) | |
| 21-12 | I298E (H1), S239D (H2) | Rituximab | FMC63 | FMC63 | Rituximab | I298E (H1), S239D (H2) | |
| 21-13 | S239D/I298E (H1, H2) | FMC63 | Rituximab | Rituximab | FMC63 | S239D/I298E (H1, H2) | |
| 21-14 | S239D/I298E (H1, H2) | FMC63 | Rituximab | Rituximab | FMC63 | S239D/I298E (H1, H2) | |
| 21-15 | S239D/I298E (H1, H2) | FMC63 | Rituximab | Rituximab | FMC63 | S239D/I298E (H1, H2) | |
| 21-16 | S239D/I298E (H1, H2) | Rituximab | FMC63 | FMC63 | Rituximab | S239D/I298E (H1, H2) | |
| 21-17 | S239D/I298E (H1, H2) | Rituximab | FMC63 | FMC63 | Rituximab | S239D/I298E (H1, H2) | |
| 21-18 | S239D/I298E (H1, H2) | Rituximab | FMC63 | FMC63 | Rituximab | S239D/I298E (H1, H2) | |
| 21-19 | | | | | | | mAb |
| 21-20 | | | | | | | mAb |
| 21-21 | wild-type | Rituximab | Rituximab | Rituximab | Rituximab | wild-type | |
| 21-22 | S239D (H1), I298E (H2) | Rituximab | Rituximab | Rituximab | Rituximab | S239D (H1), I298E (H2) | |
| 21-23 | I298E (H1), S239D (H2) | Rituximab | Rituximab | Rituximab | Rituximab | I298E (H1), S239D (H2) | |
| 21-24 | S239D/I298E (H1, H2) | Rituximab | Rituximab | Rituximab | Rituximab | S239D/I298E (H1, H2) | |
| 21-25 | | | | | | | mAb |
| 21-26 | | | | | | | mAb |
| 21-27 | wild-type | FMC63 | FMC63 | FMC63 | FMC63 | wild-type | |
| 21-28 | S239D (H1), I298E (H2) | FMC63 | FMC63 | FMC63 | FMC63 | S239D (H1), I298E (H2) | |
| 21-29 | I298E (H1), S239D (H2) | FMC63 | FMC63 | FMC63 | FMC63 | I298E (H1), S239D (H2) | |
| 21-30 | S239D/I298E (H1, H2) | FMC63 | FMC63 | FMC63 | FMC63 | S239D/I298E (H1, H2) | |
| 21-31 | wild-type | FMC60 | Rituximab | Rituximab | FMC60 | wild-type | |
| 21-32 | wild-type | FMC60 | Rituximab | Rituximab | FMC60 | wild-type | |
| 21-33 | wild-type | FMC60 | Rituximab | Rituximab | FMC60 | wild-type | |
| 21-34 | wild-type | FMC60 | Rituximab | Rituximab | FMC60 | wild-type | |
| 21-35 | wild-type | Rituximab | FMC60 | FMC60 | Rituximab | wild-type | |

TABLE 55-continued

| Protein ID | D1-Fc | D5-Fab | D4-Fab | D3-Fab | D6-Fab | D2-Fc | Other |
|---|---|---|---|---|---|---|---|
| 21-36 | wild-type | Rituximab | FMC60 | FMC60 | Rituximab | wild-type | |
| 21-37 | wild-type | Rituximab | FMC60 | FMC60 | Rituximab | wild-type | |
| 21-38 | wild-type | Rituximab | FMC60 | FMC60 | Rituximab | wild-type | |
| 21-39 | S239D (H1), I298E (H2) | FMC60 | Rituximab | Rituximab | FMC60 | S239D (H1), I298E (H2) | |
| 21-40 | S239D (H1), I298E (H2) | FMC60 | Rituximab | Rituximab | FMC60 | S239D (H1), I298E (H2) | |
| 21-41 | S239D (H1), I298E (H2) | FMC60 | Rituximab | Rituximab | FMC60 | S239D (H1), I298E (H2) | |
| 21-42 | S239D (H1), I298E (H2) | FMC60 | Rituximab | Rituximab | FMC60 | S239D (H1), I298E (H2) | |
| 21-43 | S239D (H1), I298E (H2) | Rituximab | FMC60 | FMC60 | Rituximab | S239D (H1), I298E (H2) | |
| 21-44 | S239D (H1), I298E (H2) | Rituximab | FMC60 | FMC60 | Rituximab | S239D (H1), I298E (H2) | |
| 21-45 | S239D (H1), I298E (H2) | Rituximab | FMC60 | FMC60 | Rituximab | S239D (H1), I298E (H2) | |
| 21-46 | S239D (H1), I298E (H2) | Rituximab | FMC60 | FMC60 | Rituximab | S239D (H1), I298E (H2) | |
| 21-47 | I298E (H1), S239D (H2) | FMC60 | Rituximab | Rituximab | FMC60 | I298E (H1), S239D (H2) | |
| 21-48 | I298E (H1), S239D (H2) | FMC60 | Rituximab | Rituximab | FMC60 | I298E (H1), S239D (H2) | |
| 21-49 | I298E (H1), S239D (H2) | FMC60 | Rituximab | Rituximab | FMC60 | I298E (H1), S239D (H2) | |
| 21-50 | I298E (H1), S239D (H2) | FMC60 | Rituximab | Rituximab | FMC60 | I298E (H1), S239D (H2) | |
| 21-51 | I298E (H1), S239D (H2) | Rituximab | FMC60 | FMC60 | Rituximab | I298E (H1), S239D (H2) | |
| 21-52 | I298E (H1), S239D (H2) | Rituximab | FMC60 | FMC60 | Rituximab | I298E (H1), S239D (H2) | |
| 21-53 | I298E (H1), S239D (H2) | Rituximab | FMC60 | FMC60 | Rituximab | I298E (H1), S239D (H2) | |
| 21-54 | I298E (H1), S239D (H2) | Rituximab | FMC60 | FMC60 | Rituximab | I298E (H1), S239D (H2) | |
| 21-55 | S239D/I298E (H1, H2) | FMC60 | Rituximab | Rituximab | FMC60 | S239D/I298E (H1, H2) | |
| 21-56 | S239D/I298E (H1, H2) | FMC60 | Rituximab | Rituximab | FMC60 | S239D/I298E (H1, H2) | |
| 21-57 | S239D/I298E (H1, H2) | FMC60 | Rituximab | Rituximab | FMC60 | S239D/I298E (H1, H2) | |
| 21-58 | S239D/I298E (H1, H2) | FMC60 | Rituximab | Rituximab | FMC60 | S239D/I298E (H1, H2) | |
| 21-59 | S239D/I298E (H1, H2) | Rituximab | FMC60 | FMC60 | Rituximab | S239D/I298E (H1, H2) | |
| 21-60 | S239D/I298E (H1, H2) | Rituximab | FMC60 | FMC60 | Rituximab | S239D/I298E (H1, H2) | |
| 21-61 | S239D/I298E (H1, H2) | Rituximab | FMC60 | FMC60 | Rituximab | S239D/I298E (H1, H2) | |
| 21-62 | S239D/I298E (H1, H2) | Rituximab | FMC60 | FMC60 | Rituximab | S239D/I298E (H1, H2) | |
| 21-63 | | | | | | | mAb |
| 21-64 | | | | | | | mAb |
| 21-65 | wild-type | FMC60 | FMC60 | FMC60 | FMC60 | wild-type | |
| 21-66 | S239D (H1), I298E (H2) | FMC60 | FMC60 | FMC60 | FMC60 | S239D (H1), I298E (H2) | |
| 21-67 | I298E (H1), S239D (H2) | FMC60 | FMC60 | FMC60 | FMC60 | I298E (H1), S239D (H2) | |
| 21-68 | S239D/I298E (H1, H2) | FMC60 | FMC60 | FMC60 | FMC60 | S239D/I298E (H1, H2) | |
| 21-69 | wild-type | FMC59 | Rituximab | Rituximab | FMC59 | wild-type | |
| 21-70 | wild-type | FMC59 | Rituximab | Rituximab | FMC59 | wild-type | |
| 21-71 | wild-type | FMC59 | Rituximab | Rituximab | FMC59 | wild-type | |
| 21-72 | wild-type | FMC59 | Rituximab | Rituximab | FMC59 | wild-type | |
| 21-73 | wild-type | Rituximab | FMC59 | FMC59 | Rituximab | wild-type | |
| 21-74 | wild-type | Rituximab | FMC59 | FMC59 | Rituximab | wild-type | |
| 21-75 | wild-type | Rituximab | FMC59 | FMC59 | Rituximab | wild-type | |
| 21-76 | wild-type | Rituximab | FMC59 | FMC59 | Rituximab | wild-type | |
| 21-77 | S239D (H1), I298E (H2) | FMC59 | Rituximab | Rituximab | FMC59 | S239D (H1), I298E (H2) | |
| 21-78 | S239D (H1), I298E (H2) | FMC59 | Rituximab | Rituximab | FMC59 | S239D (H1), I298E (H2) | |
| 21-79 | S239D (H1), I298E (H2) | FMC59 | Rituximab | Rituximab | FMC59 | S239D (H1), I298E (H2) | |
| 21-80 | S239D (H1), I298E (H2) | FMC59 | Rituximab | Rituximab | FMC59 | S239D (H1), I298E (H2) | |
| 21-81 | S239D (H1), I298E (H2) | Rituximab | FMC59 | FMC59 | Rituximab | S239D (H1), I298E (H2) | |
| 21-82 | S239D (H1), I298E (H2) | Rituximab | FMC59 | FMC59 | Rituximab | S239D (H1), I298E (H2) | |
| 21-83 | S239D (H1), I298E (H2) | Rituximab | FMC59 | FMC59 | Rituximab | S239D (H1), I298E (H2) | |
| 21-84 | S239D (H1), I298E (H2) | Rituximab | FMC59 | FMC59 | Rituximab | S239D (H1), I298E (H2) | |
| 21-85 | I298E (H1), S239D (H2) | FMC59 | Rituximab | Rituximab | FMC59 | I298E (H1), S239D (H2) | |
| 21-86 | I298E (H1), S239D (H2) | FMC59 | Rituximab | Rituximab | FMC59 | I298E (H1), S239D (H2) | |
| 21-87 | I298E (H1), S239D (H2) | FMC59 | Rituximab | Rituximab | FMC59 | I298E (H1), S239D (H2) | |
| 21-88 | I298E (H1), S239D (H2) | FMC59 | Rituximab | Rituximab | FMC59 | I298E (H1), S239D (H2) | |
| 21-89 | I298E (H1), S239D (H2) | Rituximab | FMC59 | FMC59 | Rituximab | I298E (H1), S239D (H2) | |
| 21-90 | I298E (H1), S239D (H2) | Rituximab | FMC59 | FMC59 | Rituximab | I298E (H1), S239D (H2) | |
| 21-91 | I298E (H1), S239D (H2) | Rituximab | FMC59 | FMC59 | Rituximab | I298E (H1), S239D (H2) | |
| 21-92 | I298E (H1), S239D (H2) | Rituximab | FMC59 | FMC59 | Rituximab | I298E (H1), S239D (H2) | |
| 21-93 | S239D/I298E (H1, H2) | FMC59 | Rituximab | Rituximab | FMC59 | S239D/I298E (H1, H2) | |
| 21-94 | S239D/I298E (H1, H2) | FMC59 | Rituximab | Rituximab | FMC59 | S239D/I298E (H1, H2) | |
| 21-95 | S239D/I298E (H1, H2) | FMC59 | Rituximab | Rituximab | FMC59 | S239D/I298E (H1, H2) | |
| 21-96 | S239D/I298E (H1, H2) | FMC59 | Rituximab | Rituximab | FMC59 | S239D/I298E (H1, H2) | |
| 21-97 | S239D/I298E (H1, H2) | Rituximab | FMC59 | FMC59 | Rituximab | S239D/I298E (H1, H2) | |
| 21-98 | S239D/I298E (H1, H2) | Rituximab | FMC59 | FMC59 | Rituximab | S239D/I298E (H1, H2) | |
| 21-99 | S239D/I298E (H1, H2) | Rituximab | FMC59 | FMC59 | Rituximab | S239D/I298E (H1, H2) | |
| 21-100 | S239D/I298E (H1, H2) | Rituximab | FMC59 | FMC59 | Rituximab | S239D/I298E (H1, H2) | |
| 21-101 | | | | | | | mAb |
| 21-102 | | | | | | | mAb |
| 21-103 | wild-type | FMC59 | FMC59 | FMC59 | FMC59 | wild-type | |
| 21-104 | S239D (H1), I298E (H2) | FMC59 | FMC59 | FMC59 | FMC59 | S239D (H1), I298E (H2) | |
| 21-105 | I298E (H1), S239D (H2) | FMC59 | FMC59 | FMC59 | FMC59 | I298E (H1), S239D (H2) | |
| 21-106 | S239D/I298E (H1, H2) | FMC59 | FMC59 | FMC59 | FMC59 | S239D/I298E (H1, H2) | |
| 21-107 | wild-type | B13 | Rituximab | Rituximab | B13 | wild-type | |
| 21-108 | wild-type | B13 | Rituximab | Rituximab | B13 | wild-type | |
| 21-109 | wild-type | B13 | FMC63 | FMC63 | B13 | wild-type | |
| 21-110 | wild-type | B13 | FMC63 | FMC63 | B13 | wild-type | |
| 21-111 | wild-type | Rituximab | B13 | B13 | Rituximab | wild-type | |
| 21-112 | wild-type | Rituximab | B13 | B13 | Rituximab | wild-type | |

TABLE 55-continued

| Protein ID | D1-Fc | D5-Fab | D4-Fab | D3-Fab | D6-Fab | D2-Fc | Other |
|---|---|---|---|---|---|---|---|
| 21-113 | wild-type | FMC63 | B13 | B13 | FMC63 | wild-type | |
| 21-114 | wild-type | FMC63 | B13 | B13 | FMC63 | wild-type | |
| 21-115 | wild-type | O24 | Rituximab | Rituximab | O24 | wild-type | |
| 21-116 | wild-type | O24 | Rituximab | Rituximab | O24 | wild-type | |
| 21-117 | wild-type | O24 | FMC63 | FMC63 | O24 | wild-type | |
| 21-118 | wild-type | O24 | FMC63 | FMC63 | O24 | wild-type | |
| 21-119 | wild-type | Rituximab | O24 | O24 | Rituximab | wild-type | |
| 21-120 | wild-type | Rituximab | O24 | O24 | Rituximab | wild-type | |
| 21-121 | wild-type | FMC63 | O24 | O24 | FMC63 | wild-type | |
| 21-122 | wild-type | FMC63 | O24 | O24 | FMC63 | wild-type | |
| 21-123 | wild-type | | Rituximab | Rituximab | | wild-type | |
| 21-124 | wild-type | | FMC63 | FMC63 | | wild-type | |
| 21-125 | wild-type | | FMC60 | FMC60 | | wild-type | |
| 21-126 | wild-type | | FMC59 | FMC59 | | wild-type | |
| 21-127 | S239D/I298E (H1, H2) | | Rituximab | Rituximab | | S239D/I298E (H1, H2) | |
| 21-128 | S239D/I298E (H1, H2) | | FMC63 | FMC63 | | S239D/I298E (H1, H2) | |
| 21-129 | S239D/I298E (H1, H2) | | FMC60 | FMC60 | | S239D/I298E (H1, H2) | |
| 21-130 | S239D/I298E (H1, H2) | | FMC59 | FMC59 | | S239D/I298E (H1, H2) | |

TABLE 56

| Protein ID | D1-Fc Specificity | D5-Fab Specificity | D4-Fab Specificity | D3-Fab Specificity | D6-Fab Specificity | D2-Fc Specificity | Other |
|---|---|---|---|---|---|---|---|
| 21-01 | FcgR enhanced (asymmetric) | CD19 | CD20 | CD20 | CD19 | FcgR enhanced (asymmetric) | |
| 21-02 | FcgR enhanced (asymmetric) | CD19 | CD20 | CD20 | CD19 | FcgR enhanced (asymmetric) | |
| 21-03 | FcgR enhanced (asymmetric) | CD19 | CD20 | CD20 | CD19 | FcgR enhanced (asymmetric) | |
| 21-04 | FcgR enhanced (asymmetric) | CD20 | CD19 | CD19 | CD20 | FcgR enhanced (asymmetric) | |
| 21-05 | FcgR enhanced (asymmetric) | CD20 | CD19 | CD19 | CD20 | FcgR enhanced (asymmetric) | |
| 21-06 | FcgR enhanced (asymmetric) | CD20 | CD19 | CD19 | CD20 | FcgR enhanced (asymmetric) | |
| 21-07 | FcgR enhanced (asymmetric) | CD19 | CD20 | CD20 | CD19 | FcgR enhanced (asymmetric) | |
| 21-08 | FcgR enhanced (asymmetric) | CD19 | CD20 | CD20 | CD19 | FcgR enhanced (asymmetric) | |
| 21-09 | FcgR enhanced (asymmetric) | CD19 | CD20 | CD20 | CD19 | FcgR enhanced (asymmetric) | |
| 21-10 | FcgR enhanced (asymmetric) | CD20 | CD19 | CD19 | CD20 | FcgR enhanced (asymmetric) | |
| 21-11 | FcgR enhanced (asymmetric) | CD20 | CD19 | CD19 | CD20 | FcgR enhanced (asymmetric) | |
| 21-12 | FcgR enhanced (asymmetric) | CD20 | CD19 | CD19 | CD20 | FcgR enhanced (asymmetric) | |
| 21-13 | FcgR enhanced (symmetric) | CD19 | CD20 | CD20 | CD19 | FcgR enhanced (symmetric) | |
| 21-14 | FcgR enhanced (symmetric) | CD19 | CD20 | CD20 | CD19 | FcgR enhanced (symmetric) | |
| 21-15 | FcgR enhanced (symmetric) | CD19 | CD20 | CD20 | CD19 | FcgR enhanced (symmetric) | |
| 21-16 | FcgR enhanced (symmetric) | CD20 | CD19 | CD19 | CD20 | FcgR enhanced (symmetric) | |
| 21-17 | FcgR enhanced (symmetric) | CD20 | CD19 | CD19 | CD20 | FcgR enhanced (symmetric) | |
| 21-18 | FcgR enhanced (symmetric) | CD20 | CD19 | CD19 | CD20 | FcgR enhanced (symmetric) | |
| 21-19 | | | | | | | mAb |
| 21-20 | | | | | | | mAb |
| 21-21 | FcgR wild-type | CD20 | CD20 | CD20 | CD20 | FcgR wild-type | |
| 21-22 | FcgR enhanced (asymmetric) | CD20 | CD20 | CD20 | CD20 | FcgR enhanced (asymmetric) | |
| 21-23 | FcgR enhanced (asymmetric) | CD20 | CD20 | CD20 | CD20 | FcgR enhanced (asymmetric) | |
| 21-24 | FcgR enhanced (symmetric) | CD20 | CD20 | CD20 | CD20 | FcgR enhanced (symmetric) | |
| 21-25 | | | | | | | mAb |
| 21-26 | | | | | | | mAb |
| 21-27 | FcgR wild-type | CD19 | CD19 | CD19 | CD19 | FcgR wild-type | |
| 21-28 | FcgR enhanced (asymmetric) | CD19 | CD19 | CD19 | CD19 | FcgR enhanced (asymmetric) | |
| 21-29 | FcgR enhanced (asymmetric) | CD19 | CD19 | CD19 | CD19 | FcgR enhanced (asymmetric) | |
| 21-30 | FcgR enhanced (symmetric) | CD19 | CD19 | CD19 | CD19 | FcgR enhanced (symmetric) | |
| 21-31 | FcgR wild-type | CD19 | CD20 | CD20 | CD19 | FcgR wild-type | |
| 21-32 | FcgR wild-type | CD19 | CD20 | CD20 | CD19 | FcgR wild-type | |
| 21-33 | FcgR wild-type | CD19 | CD20 | CD20 | CD19 | FcgR wild-type | |
| 21-34 | FcgR wild-type | CD19 | CD20 | CD20 | CD19 | FcgR wild-type | |
| 21-35 | FcgR wild-type | CD20 | CD19 | CD19 | CD20 | FcgR wild-type | |
| 21-36 | FcgR wild-type | CD20 | CD19 | CD19 | CD20 | FcgR wild-type | |
| 21-37 | FcgR wild-type | CD20 | CD19 | CD19 | CD20 | FcgR wild-type | |
| 21-38 | FcgR wild-type | CD20 | CD19 | CD19 | CD20 | FcgR wild-type | |
| 21-39 | FcgR enhanced (asymmetric) | CD19 | CD20 | CD20 | CD19 | FcgR enhanced (asymmetric) | |
| 21-40 | FcgR enhanced (asymmetric) | CD19 | CD20 | CD20 | CD19 | FcgR enhanced (asymmetric) | |
| 21-41 | FcgR enhanced (asymmetric) | CD19 | CD20 | CD20 | CD19 | FcgR enhanced (asymmetric) | |
| 21-42 | FcgR enhanced (asymmetric) | CD19 | CD20 | CD20 | CD19 | FcgR enhanced (asymmetric) | |
| 21-43 | FcgR enhanced (asymmetric) | CD20 | CD19 | CD19 | CD20 | FcgR enhanced (asymmetric) | |
| 21-44 | FcgR enhanced (asymmetric) | CD20 | CD19 | CD19 | CD20 | FcgR enhanced (asymmetric) | |
| 21-45 | FcgR enhanced (asymmetric) | CD20 | CD19 | CD19 | CD20 | FcgR enhanced (asymmetric) | |
| 21-46 | FcgR enhanced (asymmetric) | CD20 | CD19 | CD19 | CD20 | FcgR enhanced (asymmetric) | |
| 21-47 | FcgR enhanced (asymmetric) | CD19 | CD20 | CD20 | CD19 | FcgR enhanced (asymmetric) | |
| 21-48 | FcgR enhanced (asymmetric) | CD19 | CD20 | CD20 | CD19 | FcgR enhanced (asymmetric) | |
| 21-49 | FcgR enhanced (asymmetric) | CD19 | CD20 | CD20 | CD19 | FcgR enhanced (asymmetric) | |
| 21-50 | FcgR enhanced (asymmetric) | CD19 | CD20 | CD20 | CD19 | FcgR enhanced (asymmetric) | |

TABLE 56-continued

| Protein ID | D1-Fc Specificity | D5-Fab Specificity | D4-Fab Specificity | D3-Fab Specificity | D6-Fab Specificity | D2-Fc Specificity | Other |
|---|---|---|---|---|---|---|---|
| 21-51 | FcgR enhanced (asymmetric) | CD20 | CD19 | CD19 | CD20 | FcgR enhanced (asymmetric) | |
| 21-52 | FcgR enhanced (asymmetric) | CD20 | CD19 | CD19 | CD20 | FcgR enhanced (asymmetric) | |
| 21-53 | FcgR enhanced (asymmetric) | CD20 | CD19 | CD19 | CD20 | FcgR enhanced (asymmetric) | |
| 21-54 | FcgR enhanced (asymmetric) | CD20 | CD19 | CD19 | CD20 | FcgR enhanced (asymmetric) | |
| 21-55 | FcgR enhanced (symmetric) | CD19 | CD20 | CD20 | CD19 | FcgR enhanced (symmetric) | |
| 21-56 | FcgR enhanced (symmetric) | CD19 | CD20 | CD20 | CD19 | FcgR enhanced (symmetric) | |
| 21-57 | FcgR enhanced (symmetric) | CD19 | CD20 | CD20 | CD19 | FcgR enhanced (symmetric) | |
| 21-58 | FcgR enhanced (symmetric) | CD19 | CD20 | CD20 | CD19 | FcgR enhanced (symmetric) | |
| 21-59 | FcgR enhanced (symmetric) | CD20 | CD19 | CD19 | CD20 | FcgR enhanced (symmetric) | |
| 21-60 | FcgR enhanced (symmetric) | CD20 | CD19 | CD19 | CD20 | FcgR enhanced (symmetric) | |
| 21-61 | FcgR enhanced (symmetric) | CD20 | CD19 | CD19 | CD20 | FcgR enhanced (symmetric) | |
| 21-62 | FcgR enhanced (symmetric) | CD20 | CD19 | CD19 | CD20 | FcgR enhanced (symmetric) | |
| 21-63 | | | | | | | mAb |
| 21-64 | | | | | | | mAb |
| 21-65 | FcgR wild-type | CD19 | CD19 | CD19 | CD19 | FcgR wild-type | |
| 21-66 | FcgR enhanced (asymmetric) | CD19 | CD19 | CD19 | CD19 | FcgR enhanced (asymmetric) | |
| 21-67 | FcgR enhanced (asymmetric) | CD19 | CD19 | CD19 | CD19 | FcgR enhanced (asymmetric) | |
| 21-68 | FcgR enhanced (symmetric) | CD19 | CD19 | CD19 | CD19 | FcgR enhanced (symmetric) | |
| 21-69 | FcgR wild-type | CD19 | CD19 | CD19 | CD19 | FcgR wild-type | |
| 21-70 | FcgR wild-type | CD19 | CD19 | CD19 | CD19 | FcgR wild-type | |
| 21-71 | FcgR wild-type | CD19 | CD19 | CD19 | CD19 | FcgR wild-type | |
| 21-72 | FcgR wild-type | CD19 | CD19 | CD19 | CD19 | FcgR wild-type | |
| 21-73 | FcgR wild-type | CD20 | CD19 | CD19 | CD20 | FcgR wild-type | |
| 21-74 | FcgR wild-type | CD20 | CD19 | CD19 | CD20 | FcgR wild-type | |
| 21-75 | FcgR wild-type | CD20 | CD19 | CD19 | CD20 | FcgR wild-type | |
| 21-76 | FcgR wild-type | CD20 | CD19 | CD19 | CD20 | FcgR wild-type | |
| 21-77 | FcgR enhanced (asymmetric) | CD19 | CD20 | CD20 | CD20 | FcgR enhanced (asymmetric) | |
| 21-78 | FcgR enhanced (asymmetric) | CD19 | CD20 | CD20 | CD19 | FcgR enhanced (asymmetric) | |
| 21-79 | FcgR enhanced (asymmetric) | CD19 | CD20 | CD20 | CD19 | FcgR enhanced (asymmetric) | |
| 21-80 | FcgR enhanced (asymmetric) | CD19 | CD20 | CD20 | CD19 | FcgR enhanced (asymmetric) | |
| 21-81 | FcgR enhanced (asymmetric) | CD20 | CD19 | CD19 | CD20 | FcgR enhanced (asymmetric) | |
| 21-82 | FcgR enhanced (asymmetric) | CD20 | CD19 | CD19 | CD20 | FcgR enhanced (asymmetric) | |
| 21-83 | FcgR enhanced (asymmetric) | CD20 | CD19 | CD19 | CD20 | FcgR enhanced (asymmetric) | |
| 21-84 | FcgR enhanced (asymmetric) | CD20 | CD19 | CD19 | CD20 | FcgR enhanced (asymmetric) | |
| 21-85 | FcgR enhanced (asymmetric) | CD19 | CD20 | CD20 | CD19 | FcgR enhanced (asymmetric) | |
| 21-86 | FcgR enhanced (asymmetric) | CD19 | CD20 | CD20 | CD19 | FcgR enhanced (asymmetric) | |
| 21-87 | FcgR enhanced (asymmetric) | CD19 | CD20 | CD20 | CD19 | FcgR enhanced (asymmetric) | |
| 21-88 | FcgR enhanced (asymmetric) | CD19 | CD20 | CD20 | CD19 | FcgR enhanced (asymmetric) | |
| 21-89 | FcgR enhanced (asymmetric) | CD20 | CD19 | CD19 | CD20 | FcgR enhanced (asymmetric) | |
| 21-90 | FcgR enhanced (asymmetric) | CD20 | CD19 | CD19 | CD20 | FcgR enhanced (asymmetric) | |
| 21-91 | FcgR enhanced (asymmetric) | CD20 | CD19 | CD19 | CD20 | FcgR enhanced (asymmetric) | |
| 21-92 | FcgR enhanced (asymmetric) | CD20 | CD19 | CD19 | CD20 | FcgR enhanced (asymmetric) | |
| 21-93 | FcgR enhanced (symmetric) | CD19 | CD20 | CD20 | CD19 | FcgR enhanced (symmetric) | |
| 21-94 | FcgR enhanced (symmetric) | CD19 | CD20 | CD20 | CD19 | FcgR enhanced (symmetric) | |
| 21-95 | FcgR enhanced (symmetric) | CD19 | CD20 | CD20 | CD19 | FcgR enhanced (symmetric) | |
| 21-96 | FcgR enhanced (symmetric) | CD19 | CD20 | CD20 | CD19 | FcgR enhanced (symmetric) | |
| 21-97 | FcgR enhanced (symmetric) | CD20 | CD19 | CD19 | CD20 | FcgR enhanced (symmetric) | |
| 21-98 | FcgR enhanced (symmetric) | CD20 | CD19 | CD19 | CD20 | FcgR enhanced (symmetric) | |
| 21-99 | FcgR enhanced (symmetric) | CD20 | CD19 | CD19 | CD20 | FcgR enhanced (symmetric) | |
| 21-100 | FcgR enhanced (symmetric) | CD20 | CD19 | CD19 | CD20 | FcgR enhanced (symmetric) | |
| 21-101 | | | | | | | mAb |
| 21-102 | | | | | | | mAb |
| 21-103 | FcgR wild-type | CD19 | CD19 | CD19 | CD19 | FcgR wild-type | |
| 21-104 | FcgR enhanced (asymmetric) | CD19 | CD19 | CD19 | CD19 | FcgR enhanced (asymmetric) | |
| 21-105 | FcgR enhanced (asymmetric) | CD19 | CD19 | CD19 | CD19 | FcgR enhanced (asymmetric) | |
| 21-106 | FcgR enhanced (symmetric) | CD19 | CD19 | CD19 | CD19 | FcgR enhanced (symmetric) | |
| 21-107 | FcgR wild-type | SARS-CoV-2 | CD20 | CD20 | SARS-CoV-2 | FcgR wild-type | |
| 21-108 | FcgR wild-type | SARS-CoV-2 | CD20 | CD20 | SARS-CoV-2 | FcgR wild-type | |
| 21-109 | FcgR wild-type | SARS-CoV-2 | CD19 | CD19 | SARS-CoV-2 | FcgR wild-type | |
| 21-110 | FcgR wild-type | SARS-CoV-2 | CD19 | CD19 | SARS-CoV-2 | FcgR wild-type | |
| 21-111 | FcgR wild-type | CD20 | SARS-CoV-2 | SARS-CoV-2 | CD20 | FcgR wild-type | |
| 21-112 | FcgR wild-type | CD20 | SARS-CoV-2 | SARS-CoV-2 | CD20 | FcgR wild-type | |
| 21-113 | FcgR wild-type | CD19 | SARS-CoV-2 | SARS-CoV-2 | CD19 | FcgR wild-type | |
| 21-114 | FcgR wild-type | CD19 | SARS-CoV-2 | SARS-CoV-2 | CD19 | FcgR wild-type | |
| 21-115 | FcgR wild-type | SARS-CoV-2 | CD20 | CD20 | SARS-CoV-2 | FcgR wild-type | |
| 21-116 | FcgR wild-type | SARS-CoV-2 | CD20 | CD20 | SARS-CoV-2 | FcgR wild-type | |
| 21-117 | FcgR wild-type | SARS-CoV-2 | CD19 | CD19 | SARS-CoV-2 | FcgR wild-type | |
| 21-118 | FcgR wild-type | SARS-CoV-2 | CD19 | CD19 | SARS-CoV-2 | FcgR wild-type | |
| 21-119 | FcgR wild-type | CD20 | SARS-CoV-2 | SARS-CoV-2 | CD20 | FcgR wild-type | |
| 21-120 | FcgR wild-type | CD20 | SARS-CoV-2 | SARS-CoV-2 | CD20 | FcgR wild-type | |
| 21-121 | FcgR wild-type | CD19 | SARS-CoV-2 | SARS-CoV-2 | CD19 | FcgR wild-type | |
| 21-122 | FcgR wild-type | CD19 | SARS-CoV-2 | SARS-CoV-2 | CD19 | FcgR wild-type | |
| 21-123 | FcgR wild-type | | CD20 | CD20 | | FcgR wild-type | |
| 21-124 | FcgR wild-type | | CD19 | CD19 | | FcgR wild-type | |
| 21-125 | FcgR wild-type | | CD19 | CD19 | | FcgR wild-type | |
| 21-126 | FcgR wild-type | | CD19 | CD19 | | FcgR wild-type | |

TABLE 56-continued

| Protein ID | D1-Fc Specificity | D5-Fab Specificity | D4-Fab Specificity | D3-Fab Specificity | D6-Fab Specificity | D2-Fc Specificity | Other |
|---|---|---|---|---|---|---|---|
| 21-127 | FcgR enhanced (symmetric) | | CD20 | CD20 | | FcgR enhanced (symmetric) | |
| 21-128 | FcgR enhanced (symmetric) | | CD19 | CD19 | | FcgR enhanced (symmetric) | |
| 21-129 | FcgR enhanced (symmetric) | | CD19 | CD19 | | FcgR enhanced (symmetric) | |
| 21-130 | FcgR enhanced (symmetric) | | CD19 | CD19 | | FcgR enhanced (symmetric) | |

TABLE 57

| | H1 Chain | | H2 Chain | | L1 Chain | | L2 Chain | | |
|---|---|---|---|---|---|---|---|---|---|
| Protein ID | V region type | Amino acid Substitutions | V region Type | Amino acid Substitutions | V region Type | Amino acid Substitutions | V region Type | Amino acid Substitutions | Other |
| 21-01 | VH-CH1 | K147E/K213E | VK-CH1 | | VK-CK | E123R/Q124K | VH-CK | | |
| 21-02 | VH-CH1 | Q39K/S183E | VK-CH1 | Q38E/S183K | VK-CK | Q38E/V133K | VH-CK | Q39K/V133E | |
| 21-03 | VH-CH1 | Q39K/S183E | VK-CH1 | Q38K/S183K | VK-CK | Q38E/V133K | VH-CK | Q39E/V133E | |
| 21-04 | VH-CH1 | K147E/K213E | VK-CH1 | | VK-CK | E123R/Q124K | VH-CK | | |
| 21-05 | VH-CH1 | Q39K/S183E | VK-CH1 | Q38E/S183K | VK-CK | Q38E/V133K | VH-CK | Q39K/V133E | |
| 21-06 | VH-CH1 | Q39K/S183E | VK-CH1 | Q38K/S183K | VK-CK | Q38E/V133K | VH-CK | Q39E/V133E | |
| 21-07 | VH-CH1 | K147E/K213E | VK-CH1 | | VK-CK | E123R/Q124K | VH-CK | | |
| 21-08 | VH-CH1 | Q39K/S183E | VK-CH1 | Q38E/S183K | VK-CK | Q38E/V133K | VH-CK | Q39K/V133E | |
| 21-09 | VH-CH1 | Q39K/S183E | VK-CH1 | Q38K/S183K | VK-CK | Q38E/V133K | VH-CK | Q39E/V133E | |
| 21-10 | VH-CH1 | K147E/K213E | VK-CH1 | | VK-CK | E123R/Q124K | VH-CK | | |
| 21-11 | VH-CH1 | Q39K/S183E | VK-CH1 | Q38E/S183K | VK-CK | Q38E/V133K | VH-CK | Q39K/V133E | |
| 21-12 | VH-CH1 | Q39K/S183E | VK-CH1 | Q38K/S183K | VK-CK | Q38E/V133K | VH-CK | Q39E/V133E | |
| 21-13 | VH-CH1 | K147E/K213E | VK-CH1 | | VK-CK | E123R/Q124K | VH-CK | | |
| 21-14 | VH-CH1 | Q39K/S183E | VK-CH1 | Q38E/S183K | VK-CK | Q38E/V133K | VH-CK | Q39K/V133E | |
| 21-15 | VH-CH1 | Q39K/S183E | VK-CH1 | Q38K/S183K | VK-CK | Q38E/V133K | VH-CK | Q39E/V133E | |
| 21-16 | VH-CH1 | K147E/K213E | VK-CH1 | | VK-CK | E123R/Q124K | VH-CK | | |
| 21-17 | VH-CH1 | Q39K/S183E | VK-CH1 | Q38E/S183K | VK-CK | Q38E/V133K | VH-CK | Q39K/V133E | |
| 21-18 | VH-CH1 | Q39K/S183E | VK-CH1 | Q38K/S183K | VK-CK | Q38E/V133K | VH-CK | Q39E/V133E | |
| 21-19 | | | | | | | | | mAb |
| 21-20 | | | | | | | | | mAb |
| 21-21 | VH-CH1 | | VH-CH1 | | VK-CK | | | | |
| 21-22 | VH-CH1 | | VH-CH1 | | VK-CK | | | | |
| 21-23 | VH-CH1 | | VH-CH1 | | VK-CK | | | | |
| 21-24 | VH-CH1 | | VH-CH1 | | VK-CK | | | | |
| 21-25 | | | | | | | | | mAb |
| 21-26 | | | | | | | | | mAb |
| 21-27 | VH-CH1 | | VH-CH1 | | VK-CK | | | | |
| 21-28 | VH-CH1 | | VH-CH1 | | VK-CK | | | | |
| 21-29 | VH-CH1 | | VH-CH1 | | VK-CK | | | | |
| 21-30 | VH-CH1 | | VH-CH1 | | VK-CK | | | | |
| 21-31 | VH-CH1 | Q39K/S183E | VK-CH1 | Q38E/S183K | VK-CK | Q38E/V133K | VH-CK | Q39K/V133E | |
| 21-32 | VH-CH1 | Q39K/S183E | VK-CH1 | Q38K/S183K | VK-CK | Q38E/V133K | VH-CK | Q39E/V133E | |
| 21-33 | VH-CH1 | Q39E/S183E | VK-CH1 | Q38E/S183K | VK-CK | Q38K/V133K | VH-CK | Q39K/V133E | |
| 21-34 | VH-CH1 | Q39E/S183E | VK-CH1 | Q38K/S183K | VK-CK | Q38K/V133K | VH-CK | Q39E/V133E | |
| 21-35 | VH-CH1 | Q39K/S183E | VK-CH1 | Q38E/S183K | VK-CK | Q38E/V133K | VH-CK | Q39K/V133E | |
| 21-36 | VH-CH1 | Q39K/S183E | VK-CH1 | Q38K/S183K | VK-CK | Q38E/V133K | VH-CK | Q39E/V133E | |
| 21-37 | VH-CH1 | Q39E/S183E | VK-CH1 | Q38E/S183K | VK-CK | Q38K/V133K | VH-CK | Q39K/V133E | |
| 21-38 | VH-CH1 | Q39E/S183E | VK-CH1 | Q38K/S183K | VK-CK | Q38K/V133K | VH-CK | Q39E/V133E | |
| 21-39 | VH-CH1 | Q39K/S183E | VK-CH1 | Q38E/S183K | VK-CK | Q38E/V133K | VH-CK | Q39K/V133E | |
| 21-40 | VH-CH1 | Q39K/S183E | VK-CH1 | Q38K/S183K | VK-CK | Q38E/V133K | VH-CK | Q39E/V133E | |
| 21-41 | VH-CH1 | Q39E/S183E | VK-CH1 | Q38E/S183K | VK-CK | Q38K/V133K | VH-CK | Q39K/V133E | |
| 21-42 | VH-CH1 | Q39E/S183E | VK-CH1 | Q38K/S183K | VK-CK | Q38K/V133K | VH-CK | Q39E/V133E | |
| 21-43 | VH-CH1 | Q39K/S183E | VK-CH1 | Q38E/S183K | VK-CK | Q38E/V133K | VH-CK | Q39K/V133E | |
| 21-44 | VH-CH1 | Q39K/S183E | VK-CH1 | Q38K/S183K | VK-CK | Q38E/V133K | VH-CK | Q39E/V133E | |
| 21-45 | VH-CH1 | Q39E/S183E | VK-CH1 | Q38E/S183K | VK-CK | Q38K/V133K | VH-CK | Q39K/V133E | |
| 21-46 | VH-CH1 | Q39E/S183E | VK-CH1 | Q38K/S183K | VK-CK | Q38K/V133K | VH-CK | Q39E/V133E | |
| 21-47 | VH-CH1 | Q39K/S183E | VK-CH1 | Q38E/S183K | VK-CK | Q38E/V133K | VH-CK | Q39K/V133E | |
| 21-48 | VH-CH1 | Q39K/S183E | VK-CH1 | Q38K/S183K | VK-CK | Q38E/V133K | VH-CK | Q39E/V133E | |
| 21-49 | VH-CH1 | Q39E/S183E | VK-CH1 | Q38E/S183K | VK-CK | Q38K/V133K | VH-CK | Q39K/V133E | |
| 21-50 | VH-CH1 | Q39E/S183E | VK-CH1 | Q38K/S183K | VK-CK | Q38K/V133K | VH-CK | Q39E/V133E | |
| 21-51 | VH-CH1 | Q39K/S183E | VK-CH1 | Q38E/S183K | VK-CK | Q38E/V133K | VH-CK | Q39K/V133E | |
| 21-52 | VH-CH1 | Q39K/S183E | VK-CH1 | Q38K/S183K | VK-CK | Q38E/V133K | VH-CK | Q39E/V133E | |
| 21-53 | VH-CH1 | Q39E/S183E | VK-CH1 | Q38E/S183K | VK-CK | Q38K/V133K | VH-CK | Q39K/V133E | |
| 21-54 | VH-CH1 | Q39E/S183E | VK-CH1 | Q38K/S183K | VK-CK | Q38K/V133K | VH-CK | Q39E/V133E | |
| 21-55 | VH-CH1 | Q39K/S183E | VK-CH1 | Q38E/S183K | VK-CK | Q38E/V133K | VH-CK | Q39K/V133E | |
| 21-56 | VH-CH1 | Q39K/S183E | VK-CH1 | Q38K/S183K | VK-CK | Q38E/V133K | VH-CK | Q39E/V133E | |
| 21-57 | VH-CH1 | Q39E/S183E | VK-CH1 | Q38E/S183K | VK-CK | Q38K/V133K | VH-CK | Q39K/V133E | |
| 21-58 | VH-CH1 | Q39E/S183E | VK-CH1 | Q38K/S183K | VK-CK | Q38K/V133K | VH-CK | Q39E/V133E | |
| 21-59 | VH-CH1 | Q39K/S183E | VK-CH1 | Q38E/S183K | VK-CK | Q38E/V133K | VH-CK | Q39K/V133E | |

TABLE 57-continued

| | H1 Chain | | H2 Chain | | L1 Chain | | L2 Chain | | |
|---|---|---|---|---|---|---|---|---|---|
| Protein ID | V region type | Amino acid Substitutions | V region Type | Amino acid Substitutions | V region Type | Amino acid Substitutions | V region Type | Amino acid Substitutions | Other |
| 21-60 | VH-CH1 | Q39K/S183E | VK-CH1 | Q38K/S183K | VK-CK | Q38E/V133K | VH-CK | Q39E/V133E | |
| 21-61 | VH-CH1 | Q39E/S183E | VK-CH1 | Q38E/S183K | VK-CK | Q38K/V133K | VH-CK | Q39K/V133E | |
| 21-62 | VH-CH1 | Q39E/S183E | VK-CH1 | Q38K/S183K | VK-CK | Q38K/V133K | VH-CK | Q39E/V133E | |
| 21-63 | | | | | | | | | mAb |
| 21-64 | | | | | | | | | mAb |
| 21-65 | VH-CH1 | | VH-CH1 | | VK-CK | | | | |
| 21-66 | VH-CH1 | | VH-CH1 | | VK-CK | | | | |
| 21-67 | VH-CH1 | | VH-CH1 | | VK-CK | | | | |
| 21-68 | VH-CH1 | | VH-CH1 | | VK-CK | | | | |
| 21-69 | VH-CH1 | Q39K/S183E | VK-CH1 | Q38E/S183K | VK-CK | Q38E/V133K | VH-CK | Q39K/V133E | |
| 21-70 | VH-CH1 | Q39K/S183E | VK-CH1 | Q38K/S183K | VK-CK | Q38E/V133K | VH-CK | Q39E/V133E | |
| 21-71 | VH-CH1 | Q39E/S183E | VK-CH1 | Q38E/S183K | VK-CK | Q38K/V133K | VH-CK | Q39K/V133E | |
| 21-72 | VH-CH1 | Q39E/S183E | VK-CH1 | Q38K/S183K | VK-CK | Q38K/V133K | VH-CK | Q39E/V133E | |
| 21-73 | VH-CH1 | Q39K/S183E | VK-CH1 | Q38E/S183K | VK-CK | Q38E/V133K | VH-CK | Q39K/V133E | |
| 21-74 | VH-CH1 | Q39K/S183E | VK-CH1 | Q38K/S183K | VK-CK | Q38E/V133K | VH-CK | Q39E/V133E | |
| 21-75 | VH-CH1 | Q39E/S183E | VK-CH1 | Q38E/S183K | VK-CK | Q38K/V133K | VH-CK | Q39K/V133E | |
| 21-76 | VH-CH1 | Q39E/S183E | VK-CH1 | Q38K/S183K | VK-CK | Q38K/V133K | VH-CK | Q39E/V133E | |
| 21-77 | VH-CH1 | Q39K/S183E | VK-CH1 | Q38E/S183K | VK-CK | Q38E/V133K | VH-CK | Q39K/V133E | |
| 21-78 | VH-CH1 | Q39K/S183E | VK-CH1 | Q38K/S183K | VK-CK | Q38E/V133K | VH-CK | Q39E/V133E | |
| 21-79 | VH-CH1 | Q39E/S183E | VK-CH1 | Q38E/S183K | VK-CK | Q38K/V133K | VH-CK | Q39K/V133E | |
| 21-80 | VH-CH1 | Q39E/S183E | VK-CH1 | Q38K/S183K | VK-CK | Q38K/V133K | VH-CK | Q39E/V133E | |
| 21-81 | VH-CH1 | Q39K/S183E | VK-CH1 | Q38E/S183K | VK-CK | Q38E/V133K | VH-CK | Q39K/V133E | |
| 21-82 | VH-CH1 | Q39K/S183E | VK-CH1 | Q38K/S183K | VK-CK | Q38E/V133K | VH-CK | Q39E/V133E | |
| 21-83 | VH-CH1 | Q39E/S183E | VK-CH1 | Q38E/S183K | VK-CK | Q38K/V133K | VH-CK | Q39K/V133E | |
| 21-84 | VH-CH1 | Q39E/S183E | VK-CH1 | Q38K/S183K | VK-CK | Q38K/V133K | VH-CK | Q39E/V133E | |
| 21-85 | VH-CH1 | Q39K/S183E | VK-CH1 | Q38E/S183K | VK-CK | Q38E/V133K | VH-CK | Q39K/V133E | |
| 21-86 | VH-CH1 | Q39K/S183E | VK-CH1 | Q38K/S183K | VK-CK | Q38E/V133K | VH-CK | Q39E/V133E | |
| 21-87 | VH-CH1 | Q39E/S183E | VK-CH1 | Q38E/S183K | VK-CK | Q38K/V133K | VH-CK | Q39K/V133E | |
| 21-88 | VH-CH1 | Q39E/S183E | VK-CH1 | Q38K/S183K | VK-CK | Q38K/V133K | VH-CK | Q39E/V133E | |
| 21-89 | VH-CH1 | Q39K/S183E | VK-CH1 | Q38E/S183K | VK-CK | Q38E/V133K | VH-CK | Q39K/V133E | |
| 21-90 | VH-CH1 | Q39K/S183E | VK-CH1 | Q38K/S183K | VK-CK | Q38E/V133K | VH-CK | Q39E/V133E | |
| 21-91 | VH-CH1 | Q39E/S183E | VK-CH1 | Q38E/S183K | VK-CK | Q38K/V133K | VH-CK | Q39K/V133E | |
| 21-92 | VH-CH1 | Q39E/S183E | VK-CH1 | Q38K/S183K | VK-CK | Q38K/V133K | VH-CK | Q39E/V133E | |
| 21-93 | VH-CH1 | Q39K/S183E | VK-CH1 | Q38E/S183K | VK-CK | Q38E/V133K | VH-CK | Q39K/V133E | |
| 21-94 | VH-CH1 | Q39K/S183E | VK-CH1 | Q38K/S183K | VK-CK | Q38E/V133K | VH-CK | Q39E/V133E | |
| 21-95 | VH-CH1 | Q39E/S183E | VK-CH1 | Q38E/S183K | VK-CK | Q38K/V133K | VH-CK | Q39K/V133E | |
| 21-96 | VH-CH1 | Q39E/S183E | VK-CH1 | Q38K/S183K | VK-CK | Q38K/V133K | VH-CK | Q39E/V133E | |
| 21-97 | VH-CH1 | Q39K/S183E | VK-CH1 | Q38E/S183K | VK-CK | Q38E/V133K | VH-CK | Q39K/V133E | |
| 21-98 | VH-CH1 | Q39K/S183E | VK-CH1 | Q38K/S183K | VK-CK | Q38E/V133K | VH-CK | Q39E/V133E | |
| 21-99 | VH-CH1 | Q39E/S183E | VK-CH1 | Q38E/S183K | VK-CK | Q38K/V133K | VH-CK | Q39K/V133E | |
| 21-100 | VH-CH1 | Q39E/S183E | VK-CH1 | Q38K/S183K | VK-CK | Q38K/V133K | VH-CK | Q39E/V133E | |
| 21-101 | | | | | | | | | mAb |
| 21-102 | | | | | | | | | mAb |
| 21-103 | VH-CH1 | | VH-CH1 | | VK-CK | | | | |
| 21-104 | VH-CH1 | | VH-CH1 | | VK-CK | | | | |
| 21-105 | VH-CH1 | | VH-CH1 | | VK-CK | | | | |
| 21-106 | VH-CH1 | | VH-CH1 | | VK-CK | | | | |
| 21-107 | VH-CH1 | Q39K/S183E | VK-CH1 | Q38E/S183K | VK-CK | Q38E/V133K | VH-CK | Q39K/V133E | |
| 21-108 | VH-CH1 | Q39K/S183E | VK-CH1 | Q38K/S183K | VK-CK | Q38E/V133K | VH-CK | Q39E/V133E | |
| 21-109 | VH-CH1 | Q39K/S183E | VK-CH1 | Q38E/S183K | VK-CK | Q38E/V133K | VH-CK | Q39K/V133E | |
| 21-110 | VH-CH1 | Q39K/S183E | VK-CH1 | Q38K/S183K | VK-CK | Q38E/V133K | VH-CK | Q39E/V133E | |
| 21-111 | VH-CH1 | Q39K/S183E | VK-CH1 | Q38E/S183K | VK-CK | Q38E/V133K | VH-CK | Q39K/V133E | |
| 21-112 | VH-CH1 | Q39K/S183E | VK-CH1 | Q38K/S183K | VK-CK | Q38E/V133K | VH-CK | Q39E/V133E | |
| 21-113 | VH-CH1 | Q39K/S183E | VK-CH1 | Q38E/S183K | VK-CK | Q38E/V133K | VH-CK | Q39K/V133E | |
| 21-114 | VH-CH1 | Q39K/S183E | VK-CH1 | Q38K/S183K | VK-CK | Q38E/V133K | VH-CK | Q39E/V133E | |
| 21-115 | VH-CH1 | Q39K/S183E | VK-CH1 | Q38E/S183K | VK-CK | Q38E/V133K | VH-CK | Q39K/V133E | |
| 21-116 | VH-CH1 | Q39K/S183E | VK-CH1 | Q38K/S183K | VK-CK | Q38E/V133K | VH-CK | Q39E/V133E | |
| 21-117 | VH-CH1 | Q39K/S183E | VK-CH1 | Q38E/S183K | VK-CK | Q38E/V133K | VH-CK | Q39K/V133E | |
| 21-118 | VH-CH1 | Q39K/S183E | VK-CH1 | Q38K/S183K | VK-CK | Q38E/V133K | VH-CK | Q39E/V133E | |
| 21-119 | VH-CH1 | Q39K/S183E | VK-CH1 | Q38E/S183K | VK-CK | Q38E/V133K | VH-CK | Q39K/V133E | |
| 21-120 | VH-CH1 | Q39K/S183E | VK-CH1 | Q38K/S183K | VK-CK | Q38E/V133K | VH-CK | Q39E/V133E | |
| 21-121 | VH-CH1 | Q39K/S183E | VK-CH1 | Q38E/S183K | VK-CK | Q38E/V133K | VH-CK | Q39K/V133E | |
| 21-122 | VH-CH1 | Q39K/S183E | VK-CH1 | Q38K/S183K | VK-CK | Q38E/V133K | VH-CK | Q39E/V133E | |
| 21-123 | VH-CH1 | | | | VK-CK | | | | Fc chain |
| 21-124 | VH-CH1 | | | | VK-CK | | | | Fc chain |
| 21-125 | VH-CH1 | | | | VK-CK | | | | Fc chain |
| 21-126 | VH-CH1 | | | | VK-CK | | | | Fc chain |
| 21-127 | VH-CH1 | | | | VK-CK | | | | Fc chain |
| 21-128 | VH-CH1 | | | | VK-CK | | | | Fc chain |

TABLE 57-continued

| | H1 Chain | | H2 Chain | | L1 Chain | | L2 Chain | | |
|---|---|---|---|---|---|---|---|---|---|
| Protein ID | V region type | Amino acid Substitutions | V region Type | Amino acid Substitutions | V region Type | Amino acid Substitutions | V region Type | Amino acid Substitutions | Other |
| 21-129 | VH-CH1 | | | | VK-CK | | | | Fc chain |
| 21-130 | VH-CH1 | | | | VK-CK | | | | Fc chain |

Example 24—Production of Control Antibodies and Fc Fusion Proteins

Twenty-six antibodies and Fc fusion proteins are produced according to Table 58 to evaluate their relative effectiveness to tetrahedral antibodies.

TABLE 58

| Protein ID | Antibody Name | Target | H1 Chain | H2 Chain | L1 Chain | L2 Chain |
|---|---|---|---|---|---|---|
| 22-01 | Adintrevimab | SARS-CoV-2 | SEQ ID NO: 4830 | | SEQ ID NO: 4849 | |
| 22-02 | Tafasitamab-cxix | CD19 | SEQ ID NO: 4831 | | SEQ ID NO: 4850 | |
| 22-03 | M971 | CD22 | SEQ ID NO: 4832 | | SEQ ID NO: 4851 | |
| 22-04 | M971/SIDE | CD22 | SEQ ID NO: 4833 | | SEQ ID NO: 4851 | |
| 22-05 | Ofatumumab | CD20 | SEQ ID NO: 4834 | | SEQ ID NO: 4852 | |
| 22-06 | Ocrelizumab | CD20 | SEQ ID NO: 4835 | | SEQ ID NO: 4853 | |
| 22-07 | Mosunetuzumab | CD20/CD3 | SEQ ID NO: 4836 | SEQ ID NO: 4837 | SEQ ID NO: 4854 | SEQ ID NO: 4855 |
| 22-08 | Etanercept | TNF-α | SEQ ID NO: 4838 | | | |
| 22-09 | Adalimumab | TNF-α | SEQ ID NO: 4839 | | SEQ ID NO: 4856 | |
| 22-10 | Vedolizumab | α4β7 | SEQ ID NO: 4840 | | SEQ ID NO: 4857 | |
| 22-11 | Ustekinumab | IL-12/23 | SEQ ID NO: 4841 | | SEQ ID NO: 4858 | |
| 22-12 | Secukinumab | IL-17A | SEQ ID NO: 4842 | | SEQ ID NO: 4859 | |
| 22-13 | Pembrolizumab | PD-1 | SEQ ID NO: 4843 | | SEQ ID NO: 4860 | |
| 22-14 | Ipilimumab | CTLA-4 | SEQ ID NO: 4844 | | SEQ ID NO: 4861 | |
| 22-15 | 388D4-3 | PD-1 | SEQ ID NO: 4845 | | SEQ ID NO: 4862 | |
| 22-16 | 244C8-2 | PD-1 | SEQ ID NO: 4846 | | SEQ ID NO: 4863 | |
| 22-17 | Atezolizumab | PD-L1 | SEQ ID NO: 4847 | | SEQ ID NO: 4864 | |
| 22-18 | B6055 | PD-L1 | SEQ ID NO: 4848 | | SEQ ID NO: 4865 | |
| 22-19 | Trastuzumab | ERBB2 | SEQ ID NO: 5091 | | SEQ ID NO: 5099 | |
| 22-20 | Cetuximab | EGFR | SEQ ID NO: 5092 | | SEQ ID NO: 5100 | |
| 22-21 | Pertuzumab | ERBB2 | SEQ ID NO: 5093 | | SEQ ID NO: 5101 | |
| 22-22 | Cergutuzumab | CEACAM5 | SEQ ID NO: 5094 | | SEQ ID NO: 5102 | |
| 22-23 | Bevacizumab | VEGF-A | SEQ ID NO: 5095 | | SEQ ID NO: 5103 | |
| 22-24 | Ramucirumab | VEGFR2 | SEQ ID NO: 5096 | | SEQ ID NO: 5104 | |
| 22-25 | Ontorpacept | CD47 | SEQ ID NO: 5097 | | | |
| 22-26 | Efmarodocokin alfa | IL-22R | SEQ ID NO: 5098 | | | |

Example 25—Tetravalent, Bispecific Tetrahedral Antibodies Comprising Two Distinct Fabs or Cytokine Receptors that Specifically Bind Pro-Inflammatory Cytokines and Integrins Tetrahedral antibodies were designed, expressed, and evaluated for their ability to neutralize pro-inflammatory cytokines and adhesion molecules for the treatment of inflammation and autoimmune disease. This series of bispecific constructs employ VH and VL regions from adalimumab (anti-TNFα), ustekinumab (anti-IL-12/23), secukinumab (anti-L1-17A) and vedolizumab (anti-«4b7 integrin), and portions of the TNFR1B receptor extracellular domain (Tables 59, 60). Two distinct configurations were evaluated (Table 61). In the first configuration, a first type of Fab is placed in D3/D4, and a second type of Fab is placed in D5/D6. The various Fab pairings are adalimumab/ustekinumab, adalimumab/secukinumab, ustekinumab/secukinumab and adalimumab/vedolizumab, each placed in either orientation with respect to D3/D4 and D5/D6. In the second configuration, the TNFR1B receptor extracellular domain is placed in D3/D4, and a Fab-Fc fusion, Fab/c, is placed in D1/D2. The various pairings are TNFR1B/adalimumab-Fab/c, TNFR1B/secukinumab-Fab/c, TNFR1B/secukinumab-Fab/c and TNFR1B/vedolizumab-Fab/c. To optimize correct VH/VL pairing and to minimize VH/VL mispairing, V region exchange is combined with four different sets of charge pairs to ensure correct pairing of heavy and light chain V regions (Table 62). Additionally, to further facilitate purification of the correctly paired product by Protein A chromatography, the H1 chain incorporates the H435R/Y436F substitution. The constructs are then evaluated for their structural bispecificity by intact mass spectrometry as described in Example 18, and for their functional bispecificity using a variety of in vitro binding assays, cytokine neutralization assays, adhesion inhibition assays, and in vivo inflammatory and autoimmune disease efficacy models, known to one skilled in the art.

TABLE 59

| Protein ID | H1 Chain | H2 Chain | L1 Chain | L2 Chain | Fc chain |
|---|---|---|---|---|---|
| 23-01 | SEQ ID NO: 4866 | SEQ ID NO: 4867 | SEQ ID NO: 4894 | SEQ ID NO: 4895 | |
| 23-02 | SEQ ID NO: 4866 | SEQ ID NO: 4868 | SEQ ID NO: 4894 | SEQ ID NO: 4896 | |
| 23-03 | SEQ ID NO: 4869 | SEQ ID NO: 4867 | SEQ ID NO: 4897 | SEQ ID NO: 4895 | |
| 23-04 | SEQ ID NO: 4869 | SEQ ID NO: 4868 | SEQ ID NO: 4897 | SEQ ID NO: 4896 | |
| 23-05 | SEQ ID NO: 4870 | SEQ ID NO: 4871 | SEQ ID NO: 4898 | SEQ ID NO: 4899 | |
| 23-06 | SEQ ID NO: 4870 | SEQ ID NO: 4872 | SEQ ID NO: 4898 | SEQ ID NO: 4900 | |
| 23-07 | SEQ ID NO: 4873 | SEQ ID NO: 4871 | SEQ ID NO: 4901 | SEQ ID NO: 4899 | |
| 23-08 | SEQ ID NO: 4873 | SEQ ID NO: 4872 | SEQ ID NO: 4901 | SEQ ID NO: 4900 | |
| 23-09 | SEQ ID NO: 4866 | SEQ ID NO: 4874 | SEQ ID NO: 4894 | SEQ ID NO: 4902 | |
| 23-10 | SEQ ID NO: 4866 | SEQ ID NO: 4875 | SEQ ID NO: 4894 | SEQ ID NO: 4903 | |
| 23-11 | SEQ ID NO: 4869 | SEQ ID NO: 4874 | SEQ ID NO: 4897 | SEQ ID NO: 4902 | |
| 23-12 | SEQ ID NO: 4869 | SEQ ID NO: 4875 | SEQ ID NO: 4897 | SEQ ID NO: 4903 | |
| 23-13 | SEQ ID NO: 4876 | SEQ ID NO: 4871 | SEQ ID NO: 4904 | SEQ ID NO: 4899 | |
| 23-14 | SEQ ID NO: 4876 | SEQ ID NO: 4872 | SEQ ID NO: 4904 | SEQ ID NO: 4900 | |
| 23-15 | SEQ ID NO: 4877 | SEQ ID NO: 4871 | SEQ ID NO: 4905 | SEQ ID NO: 4899 | |
| 23-16 | SEQ ID NO: 4877 | SEQ ID NO: 4872 | SEQ ID NO: 4905 | SEQ ID NO: 4900 | |
| 23-17 | SEQ ID NO: 4870 | SEQ ID NO: 4874 | SEQ ID NO: 4898 | SEQ ID NO: 4902 | |
| 23-18 | SEQ ID NO: 4870 | SEQ ID NO: 4875 | SEQ ID NO: 4898 | SEQ ID NO: 4903 | |
| 23-19 | SEQ ID NO: 4873 | SEQ ID NO: 4874 | SEQ ID NO: 4901 | SEQ ID NO: 4902 | |
| 23-20 | SEQ ID NO: 4873 | SEQ ID NO: 4875 | SEQ ID NO: 4901 | SEQ ID NO: 4903 | |
| 23-21 | SEQ ID NO: 4876 | SEQ ID NO: 4867 | SEQ ID NO: 4904 | SEQ ID NO: 4895 | |
| 23-22 | SEQ ID NO: 4876 | SEQ ID NO: 4868 | SEQ ID NO: 4904 | SEQ ID NO: 4896 | |
| 23-23 | SEQ ID NO: 4877 | SEQ ID NO: 4867 | SEQ ID NO: 4905 | SEQ ID NO: 4895 | |
| 23-24 | SEQ ID NO: 4877 | SEQ ID NO: 4868 | SEQ ID NO: 4905 | SEQ ID NO: 4896 | |
| 23-25 | SEQ ID NO: 4878 | SEQ ID NO: 4879 | SEQ ID NO: 4894 | SEQ ID NO: 4906 | |
| 23-26 | SEQ ID NO: 4878 | SEQ ID NO: 4880 | SEQ ID NO: 4894 | SEQ ID NO: 4907 | |
| 23-27 | SEQ ID NO: 4881 | SEQ ID NO: 4879 | SEQ ID NO: 4897 | SEQ ID NO: 4906 | |
| 23-28 | SEQ ID NO: 4881 | SEQ ID NO: 4880 | SEQ ID NO: 4897 | SEQ ID NO: 4907 | |
| 23-29 | SEQ ID NO: 4882 | SEQ ID NO: 4883 | SEQ ID NO: 4908 | SEQ ID NO: 4899 | |
| 23-30 | SEQ ID NO: 4882 | SEQ ID NO: 4884 | SEQ ID NO: 4908 | SEQ ID NO: 4900 | |
| 23-31 | SEQ ID NO: 4885 | SEQ ID NO: 4883 | SEQ ID NO: 4909 | SEQ ID NO: 4899 | |
| 23-32 | SEQ ID NO: 4885 | SEQ ID NO: 4884 | SEQ ID NO: 4909 | SEQ ID NO: 4900 | |
| 23-33 | SEQ ID NO: 4886 | | SEQ ID NO: 4910 | | SEQ ID NO: 4918 |
| 23-34 | SEQ ID NO: 4887 | | SEQ ID NO: 4911 | | SEQ ID NO: 4918 |
| 23-35 | SEQ ID NO: 4888 | | SEQ ID NO: 4912 | | SEQ ID NO: 4918 |
| 23-36 | SEQ ID NO: 4889 | | SEQ ID NO: 4913 | | SEQ ID NO: 4918 |
| 23-37 | SEQ ID NO: 4890 | | SEQ ID NO: 4914 | | SEQ ID NO: 4918 |
| 23-38 | SEQ ID NO: 4891 | | SEQ ID NO: 4915 | | SEQ ID NO: 4918 |
| 23-39 | SEQ ID NO: 4892 | | SEQ ID NO: 4916 | | SEQ ID NO: 4919 |
| 23-40 | SEQ ID NO: 4893 | | SEQ ID NO: 4917 | | SEQ ID NO: 4919 |

TABLE 60

| Protein ID | D1-Fc | D1-Fab/c | D5-Fab | D4-Fab | D3-Fab | D6-Fab | D2-Fab/c | D2-Fc |
|---|---|---|---|---|---|---|---|---|
| 23-01 | wild-type | | Ustekinum | Adalimum | Adalimum | Ustekinum | | wild-type |
| 23-02 | wild-type | | Ustekinum | Adalimum | Adalimum | Ustekinum | | wild-type |
| 23-03 | wild-type | | Ustekinum | Adalimum | Adalimum | Ustekinum | | wild-type |
| 23-04 | wild-type | | Ustekinum | Adalimum | Adalimum | Ustekinum | | wild-type |
| 23-05 | wild-type | | Adalimum | Ustekinum | Ustekinum | Adalimum | | wild-type |
| 23-06 | wild-type | | Adalimum | Ustekinum | Ustekinum | Adalimum | | wild-type |
| 23-07 | wild-type | | Adalimum | Ustekinum | Ustekinum | Adalimum | | wild-type |
| 23-08 | wild-type | | Adalimum | Ustekinum | Ustekinum | Adalimum | | wild-type |
| 23-09 | wild-type | | Secukinum | Adalimum | Adalimum | Secukinum | | wild-type |
| 23-10 | wild-type | | Secukinum | Adalimum | Adalimum | Secukinum | | wild-type |
| 23-11 | wild-type | | Secukinum | Adalimum | Adalimum | Secukinum | | wild-type |
| 23-12 | wild-type | | Secukinum | Adalimum | Adalimum | Secukinum | | wild-type |
| 23-13 | wild-type | | Adalimum | Secukinum | Secukinum | Adalimum | | wild-type |
| 23-14 | wild-type | | Adalimum | Secukinum | Secukinum | Adalimum | | wild-type |
| 23-15 | wild-type | | Adalimum | Secukinum | Secukinum | Adalimum | | wild-type |
| 23-16 | wild-type | | Adalimum | Secukinum | Secukinum | Adalimum | | wild-type |
| 23-17 | wild-type | | Secukinum | Ustekinum | Ustekinum | Secukinum | | wild-type |
| 23-18 | wild-type | | Secukinum | Ustekinum | Ustekinum | Secukinum | | wild-type |
| 23-19 | wild-type | | Secukinum | Ustekinum | Ustekinum | Secukinum | | wild-type |
| 23-20 | wild-type | | Secukinum | Ustekinum | Ustekinum | Secukinum | | wild-type |
| 23-21 | wild-type | | Ustekinum | Secukinum | Secukinum | Ustekinum | | wild-type |
| 23-22 | wild-type | | Ustekinum | Secukinum | Secukinum | Ustekinum | | wild-type |
| 23-23 | wild-type | | Ustekinum | Secukinum | Secukinum | Ustekinum | | wild-type |
| 23-24 | wild-type | | Ustekinum | Secukinum | Secukinum | Ustekinum | | wild-type |
| 23-25 | L234A/L23 | | Vedolizum | Adalimum | Adalimum | Vedolizum | | L234A/L23 |
| 23-26 | L234A/L23 | | Vedolizum | Adalimum | Adalimum | Vedolizum | | L234A/L23 |
| 23-27 | L234A/L23 | | Vedolizum | Adalimum | Adalimum | Vedolizum | | L234A/L23 |

TABLE 60-continued

| Protein ID | D1-Fc | D1-Fab/c | D5-Fab | D4-Fab | D3-Fab | D6-Fab | D2-Fab/c | D2-Fc |
|---|---|---|---|---|---|---|---|---|
| 23-28 | L234A/L23 | | Vedolizum | Adalimum | Adalimum | Vedolizum | | L234A/L23 |
| 23-29 | L234A/L23 | | Adalimum | Vedolizum | Vedolizum | Adalimum | | L234A/L23 |
| 23-30 | L234A/L23 | | Adalimum | Vedolizum | Vedolizum | Adalimum | | L234A/L23 |
| 23-31 | L234A/L23 | | Adalimum | Vedolizum | Vedolizum | Adalimum | | L234A/L23 |
| 23-32 | L234A/L23 | | Adalimum | Vedolizum | Vedolizum | Adalimum | | L234A/L23 |
| 23-33 | wild-type | Adalimum | | Etanercept | Etanercept | | Adalimum | wild-type |
| 23-34 | wild-type | Adalimum | | Etanercept | Etanercept | | Adalimum | wild-type |
| 23-35 | wild-type | Ustekinum | | Etanercept | Etanercept | | Ustekinum | wild-type |
| 23-36 | wild-type | Ustekinum | | Etanercept | Etanercept | | Ustekinum | wild-type |
| 23-37 | wild-type | Secukinum | | Etanercept | Etanercept | | Secukinum | wild-type |
| 23-38 | wild-type | Secukinum | | Etanercept | Etanercept | | Secukinum | wild-type |
| 23-39 | L234A/L23 | Vedolizum | | Etanercept | Etanercept | | Vedolizum | L234A/L23 |
| 23-40 | L234A/L23 | Vedolizum | | Etanercept | Etanercept | | Vedolizum | L234A/L23 |

TABLE 61

| Protein ID | D1-Fc Specificity | D1-Fab/c Specificity | D5-Fab Specificity | D4 Specificity | D3 Specificity | D6-Fab Specificity | D2-Fab/c Specificity | D2-Fc Specificity |
|---|---|---|---|---|---|---|---|---|
| 23-01 | FcgR | | IL-12/23 | TNFα | TNFα | IL-12/23 | | FcgR |
| 23-02 | FcgR | | IL-12/23 | TNFα | TNFα | IL-12/23 | | FcgR |
| 23-03 | FcgR | | IL-12/23 | TNFα | TNFα | IL-12/23 | | FcgR |
| 23-04 | FcgR | | IL-12/23 | TNFα | TNFα | IL-12/23 | | FcgR |
| 23-05 | FcgR | | TNFα | IL-12/23 | IL-12/23 | TNFα | | FcgR |
| 23-06 | FcgR | | TNFα | IL-12/23 | IL-12/23 | TNFα | | FcgR |
| 23-07 | FcgR | | TNFα | IL-12/23 | IL-12/23 | TNFα | | FcgR |
| 23-08 | FcgR | | TNFα | IL-12/23 | IL-12/23 | TNFα | | FcgR |
| 23-09 | FcgR | | IL-17A | TNFα | TNFα | IL-17A | | FcgR |
| 23-10 | FcgR | | IL-17A | TNFα | TNFα | IL-17A | | FcgR |
| 23-11 | FcgR | | IL-17A | TNFα | TNFα | IL-17A | | FcgR |
| 23-12 | FcgR | | IL-17A | TNFα | TNFα | IL-17A | | FcgR |
| 23-13 | FcgR | | TNFα | IL-17A | IL-17A | TNFα | | FcgR |
| 23-14 | FcgR | | TNFα | IL-17A | IL-17A | TNFα | | FcgR |
| 23-15 | FcgR | | TNFα | IL-17A | IL-17A | TNFα | | FcgR |
| 23-16 | FcgR | | TNFα | IL-17A | IL-17A | TNFα | | FcgR |
| 23-17 | FcgR | | IL-17A | IL-12/23 | IL-12/23 | IL-17A | | FcgR |
| 23-18 | FcgR | | IL-17A | IL-12/23 | IL-12/23 | IL-17A | | FcgR |
| 23-19 | FcgR | | IL-17A | IL-12/23 | IL-12/23 | IL-17A | | FcgR |
| 23-20 | FcgR | | IL-17A | IL-12/23 | IL-12/23 | IL-17A | | FcgR |
| 23-21 | FcgR | | IL-12/23 | IL-17A | IL-17A | IL-12/23 | | FcgR |
| 23-22 | FcgR | | IL-12/23 | IL-17A | IL-17A | IL-12/23 | | FcgR |
| 23-23 | FcgR | | IL-12/23 | IL-17A | IL-17A | IL-12/23 | | FcgR |
| 23-24 | FcgR | | IL-12/23 | IL-17A | IL-17A | IL-12/23 | | FcgR |
| 23-25 | FcgR silent | | α4β7 | TNFα | TNFα | α4β7 | | FcgR silent |
| 23-26 | FcgR silent | | α4β7 | TNFα | TNFα | α4β7 | | FcgR silent |
| 23-27 | FcgR silent | | α4β7 | TNFα | TNFα | α4β7 | | FcgR silent |
| 23-28 | FcgR silent | | α4β7 | TNFα | TNFα | α4β7 | | FcgR silent |
| 23-29 | FcgR silent | | TNFα | α4β7 | α4β7 | TNFα | | FcgR silent |
| 23-30 | FcgR silent | | TNFα | α4β7 | α4β7 | TNFα | | FcgR silent |
| 23-31 | FcgR silent | | TNFα | α4β7 | α4β7 | TNFα | | FcgR silent |
| 23-32 | FcgR silent | | TNFα | α4β7 | α4β7 | TNFα | | FcgR silent |
| 23-33 | FcgR | TNFα | | TNFα | TNFα | | TNFα | FcgR |
| 23-34 | FcgR | TNFα | | TNFα | TNFα | | TNFα | FcgR |
| 23-35 | FcgR | IL-12/23 | | TNFα | TNFα | | IL-12/23 | FcgR |
| 23-36 | FcgR | IL-12/23 | | TNFα | TNFα | | IL-12/23 | FcgR |
| 23-37 | FcgR | IL-17A | | TNFα | TNFα | | IL-17A | FcgR |
| 23-38 | FcgR | IL-17A | | TNFα | TNFα | | IL-17A | FcgR |
| 23-39 | FcgR silent | α4β7 | | TNFα | TNFα | | α4β7 | FcgR silent |
| 23-40 | FcgR silent | α4β7 | | TNFα | TNFα | | α4β7 | FcgR silent |

TABLE 62

| | H1 Chain | | H2 Chain | | L1 Chain | | L2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 23-01 | VH-CH1 | Q39K/S183E | VK-CH1 | Q38E/S183K | VK-CK | Q38E/V133K | VH-CK | Q39K/V133E |
| 23-02 | VH-CH1 | Q39K/S183E | VK-CH1 | Q38K/S183K | VK-CK | Q38E/V133K | VH-CK | Q39E/V133E |
| 23-03 | VH-CH1 | Q39E/S183E | VK-CH1 | Q38E/S183K | VK-CK | Q38K/V133K | VH-CK | Q39K/V133E |
| 23-04 | VH-CH1 | Q39E/S183E | VK-CH1 | Q38K/S183K | VK-CK | Q38K/V133K | VH-CK | Q39E/V133E |
| 23-05 | VH-CH1 | Q39K/S183E | VK-CH1 | Q38E/S183K | VK-CK | Q38E/V133K | VH-CK | Q39K/V133E |

TABLE 62-continued

| | H1 Chain | | H2 Chain | | L1 Chain | | L2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 23-06 | VH-CH1 | Q39K/S183E | VK-CH1 | Q38K/S183K | VK-CK | Q38E/V133K | VH-CK | Q39E/V133E |
| 23-07 | VH-CH1 | Q39E/S183E | VK-CH1 | Q38E/S183K | VK-CK | Q38K/V133K | VH-CK | Q39K/V133E |
| 23-08 | VH-CH1 | Q39E/S183E | VK-CH1 | Q38K/S183K | VK-CK | Q38K/V133K | VH-CK | Q39E/V133E |
| 23-09 | VH-CH1 | Q39K/S183E | VK-CH1 | Q38E/S183K | VK-CK | Q38E/V133K | VH-CK | Q39K/V133E |
| 23-10 | VH-CH1 | Q39K/S183E | VK-CH1 | Q38K/S183K | VK-CK | Q38E/V133K | VH-CK | Q39E/V133E |
| 23-11 | VH-CH1 | Q39E/S183E | VK-CH1 | Q38E/S183K | VK-CK | Q38K/V133K | VH-CK | Q39K/V133E |
| 23-12 | VH-CH1 | Q39E/S183E | VK-CH1 | Q38K/S183K | VK-CK | Q38K/V133K | VH-CK | Q39E/V133E |
| 23-13 | VH-CH1 | Q39K/S183E | VK-CH1 | Q38E/S183K | VK-CK | Q38E/V133K | VH-CK | Q39K/V133E |
| 23-14 | VH-CH1 | Q39K/S183E | VK-CH1 | Q38K/S183K | VK-CK | Q38E/V133K | VH-CK | Q39E/V133E |
| 23-15 | VH-CH1 | Q39E/S183E | VK-CH1 | Q38E/S183K | VK-CK | Q38K/V133K | VH-CK | Q39K/V133E |
| 23-16 | VH-CH1 | Q39E/S183E | VK-CH1 | Q38K/S183K | VK-CK | Q38K/V133K | VH-CK | Q39E/V133E |
| 23-17 | VH-CH1 | Q39K/S183E | VK-CH1 | Q38E/S183K | VK-CK | Q38E/V133K | VH-CK | Q39K/V133E |
| 23-18 | VH-CH1 | Q39K/S183E | VK-CH1 | Q38K/S183K | VK-CK | Q38E/V133K | VH-CK | Q39E/V133E |
| 23-19 | VH-CH1 | Q39E/S183E | VK-CH1 | Q38E/S183K | VK-CK | Q38K/V133K | VH-CK | Q39K/V133E |
| 23-20 | VH-CH1 | Q39E/S183E | VK-CH1 | Q38K/S183K | VK-CK | Q38K/V133K | VH-CK | Q39E/V133E |
| 23-21 | VH-CH1 | Q39K/S183E | VK-CH1 | Q38E/S183K | VK-CK | Q38E/V133K | VH-CK | Q39K/V133E |
| 23-22 | VH-CH1 | Q39K/S183E | VK-CH1 | Q38K/S183K | VK-CK | Q38E/V133K | VH-CK | Q39E/V133E |
| 23-23 | VH-CH1 | Q39E/S183E | VK-CH1 | Q38E/S183K | VK-CK | Q38K/V133K | VH-CK | Q39K/V133E |
| 23-24 | VH-CH1 | Q39E/S183E | VK-CH1 | Q38K/S183K | VK-CK | Q38K/V133K | VH-CK | Q39E/V133E |
| 23-25 | VH-CH1 | Q39K/S183E | VK-CH1 | Q38E/S183K | VK-CK | Q38E/V133K | VH-CK | Q39K/V133E |
| 23-26 | VH-CH1 | Q39K/S183E | VK-CH1 | Q38K/S183K | VK-CK | Q38E/V133K | VH-CK | Q39E/V133E |
| 23-27 | VH-CH1 | Q39E/S183E | VK-CH1 | Q38E/S183K | VK-CK | Q38K/V133K | VH-CK | Q39K/V133E |
| 23-28 | VH-CH1 | Q39E/S183E | VK-CH1 | Q38K/S183K | VK-CK | Q38K/V133K | VH-CK | Q39E/V133E |
| 23-29 | VH-CH1 | Q39K/S183E | VK-CH1 | Q38E/S183K | VK-CK | Q38E/V133K | VH-CK | Q39K/V133E |
| 23-30 | VH-CH1 | Q39K/S183E | VK-CH1 | Q38K/S183K | VK-CK | Q38E/V133K | VH-CK | Q39E/V133E |
| 23-31 | VH-CH1 | Q39E/S183E | VK-CH1 | Q38E/S183K | VK-CK | Q38K/V133K | VH-CK | Q39K/V133E |
| 23-32 | VH-CH1 | Q39E/S183E | VK-CH1 | Q38K/S183K | VK-CK | Q38K/V133K | VH-CK | Q39E/V133E |
| 23-33 | VH-CH1 | | | | VK-CK | | | |
| 23-34 | VK-CH1 | | | | VH-CK | | | |
| 23-35 | VH-CH1 | | | | VK-CK | | | |
| 23-36 | VK-CH1 | | | | VH-CK | | | |
| 23-37 | VH-CH1 | | | | VK-CK | | | |
| 23-38 | VK-CH1 | | | | VH-CK | | | |
| 23-39 | VH-CH1 | | | | VK-CK | | | |
| 23-40 | VK-CH1 | | | | VH-CK | | | |

Example 26—Trivalent/Tetravalent, Bispecific Tetrahedral Antibodies Comprising Two Distinct Fabs that Specifically Bind PD-1 and CTLA-4, or PD-1 Biparatopically Tetrahedral antibodies were designed, expressed, and evaluated for their ability to act as checkpoint inhibitors for the treatment of cancer and other disease. This series of bispecific constructs employ VH and VL regions from pembrolizumab (anti-PD-1), ipilimumab (anti-CTLA-4), 388D4 (anti-PD-1) and 244C8 (anti-PD-1) (Tables 63, 64). The epitope recognized by 388D4, an orthostatic inhibitor of PD-1, overlaps with that of pembrolizumab, while the epitope recognized by 244C8, an allosteric inhibitor of PD-1, is at a distinct site. The various Fab pairings are pembrolizumab/ipilimumab, 388D4/ipilimumab, and 388D4/244C8, each placed in either orientation with respect to D3/D4 and D5/D6. Two tetrahedral antibody configurations were employed (Table 65). In the first configuration, the anti-PD-1 Fab domain is placed in either of D3/D4 or D5/D6 (bivalent), and the CTLA-4 targeting Fab domain or second anti-PD-L1 Fab domain is placed in the other of D5/D6 or D3/D4 (bivalent). In the second configuration, the anti-PD-1 Fab domain is placed in D3/D4 (bivalent) and the CTLA-4 targeting Fab domain is placed in D6 (monovalent). To optimize correct VH/VL pairing and to minimize VH/VL mispairing, V region exchange is combined with four different sets of charge pairs to ensure correct pairing of heavy and light chain V regions (Table 66). Additionally, to further facilitate purification of the correctly paired product by Protein A chromatography, the H1 chain incorporates the H435R/Y436F substitution. The constructs are then evaluated for their structural bispecificity by intact mass spectrometry as described in Example 18, and for their functional bispecificity using a variety of in vitro binding assays, checkpoint inhibition assays, and in vivo cancer and related disease efficacy models, known to one skilled in the art.

TABLE 63

| Protein ID | H1 Chain | H2 Chain | L1 Chain | L2 Chain | Fc chain |
|---|---|---|---|---|---|
| 24-01 | SEQ ID NO: 4920 | SEQ ID NO: 4921 | SEQ ID NO: 4938 | SEQ ID NO: 4939 | |
| 24-02 | SEQ ID NO: 4920 | SEQ ID NO: 4922 | SEQ ID NO: 4938 | SEQ ID NO: 4940 | |
| 24-03 | SEQ ID NO: 4923 | SEQ ID NO: 4921 | SEQ ID NO: 4941 | SEQ ID NO: 4939 | |
| 24-04 | SEQ ID NO: 4923 | SEQ ID NO: 4922 | SEQ ID NO: 4941 | SEQ ID NO: 4940 | |
| 24-05 | SEQ ID NO: 4920 | SEQ ID NO: 4924 | SEQ ID NO: 4938 | SEQ ID NO: 4939 | SEQ ID NO: 4954 |
| 24-06 | SEQ ID NO: 4920 | SEQ ID NO: 4925 | SEQ ID NO: 4938 | SEQ ID NO: 4940 | SEQ ID NO: 4954 |
| 24-07 | SEQ ID NO: 4923 | SEQ ID NO: 4924 | SEQ ID NO: 4941 | SEQ ID NO: 4939 | SEQ ID NO: 4954 |
| 24-08 | SEQ ID NO: 4923 | SEQ ID NO: 4925 | SEQ ID NO: 4941 | SEQ ID NO: 4940 | SEQ ID NO: 4954 |

TABLE 63-continued

| Protein ID | H1 Chain | H2 Chain | L1 Chain | L2 Chain | Fc chain |
|---|---|---|---|---|---|
| 24-09 | SEQ ID NO: 4926 | SEQ ID NO: 4927 | SEQ ID NO: 4942 | SEQ ID NO: 4943 | |
| 24-10 | SEQ ID NO: 4926 | SEQ ID NO: 4928 | SEQ ID NO: 4942 | SEQ ID NO: 4944 | |
| 24-11 | SEQ ID NO: 4929 | SEQ ID NO: 4927 | SEQ ID NO: 4945 | SEQ ID NO: 4943 | |
| 24-12 | SEQ ID NO: 4929 | SEQ ID NO: 4928 | SEQ ID NO: 4945 | SEQ ID NO: 4944 | |
| 24-13 | SEQ ID NO: 4930 | SEQ ID NO: 4921 | SEQ ID NO: 4946 | SEQ ID NO: 4939 | |
| 24-14 | SEQ ID NO: 4930 | SEQ ID NO: 4922 | SEQ ID NO: 4946 | SEQ ID NO: 4940 | |
| 24-15 | SEQ ID NO: 4931 | SEQ ID NO: 4921 | SEQ ID NO: 4947 | SEQ ID NO: 4939 | |
| 24-16 | SEQ ID NO: 4931 | SEQ ID NO: 4922 | SEQ ID NO: 4947 | SEQ ID NO: 4940 | |
| 24-17 | SEQ ID NO: 4930 | SEQ ID NO: 4924 | SEQ ID NO: 4946 | SEQ ID NO: 4939 | SEQ ID NO: 4954 |
| 24-18 | SEQ ID NO: 4930 | SEQ ID NO: 4925 | SEQ ID NO: 4946 | SEQ ID NO: 4940 | SEQ ID NO: 4954 |
| 24-19 | SEQ ID NO: 4931 | SEQ ID NO: 4924 | SEQ ID NO: 4947 | SEQ ID NO: 4939 | SEQ ID NO: 4954 |
| 24-20 | SEQ ID NO: 4931 | SEQ ID NO: 4925 | SEQ ID NO: 4947 | SEQ ID NO: 4940 | SEQ ID NO: 4954 |
| 24-21 | SEQ ID NO: 4926 | SEQ ID NO: 4932 | SEQ ID NO: 4942 | SEQ ID NO: 4948 | |
| 24-22 | SEQ ID NO: 4926 | SEQ ID NO: 4933 | SEQ ID NO: 4942 | SEQ ID NO: 4949 | |
| 24-23 | SEQ ID NO: 4929 | SEQ ID NO: 4932 | SEQ ID NO: 4945 | SEQ ID NO: 4948 | |
| 24-24 | SEQ ID NO: 4929 | SEQ ID NO: 4933 | SEQ ID NO: 4945 | SEQ ID NO: 4949 | |
| 24-25 | SEQ ID NO: 4930 | SEQ ID NO: 4934 | SEQ ID NO: 4946 | SEQ ID NO: 4950 | |
| 24-26 | SEQ ID NO: 4930 | SEQ ID NO: 4935 | SEQ ID NO: 4946 | SEQ ID NO: 4951 | |
| 24-27 | SEQ ID NO: 4931 | SEQ ID NO: 4934 | SEQ ID NO: 4947 | SEQ ID NO: 4950 | |
| 24-28 | SEQ ID NO: 4931 | SEQ ID NO: 4935 | SEQ ID NO: 4947 | SEQ ID NO: 4951 | |
| 24-29 | SEQ ID NO: 4936 | SEQ ID NO: 4932 | SEQ ID NO: 4952 | SEQ ID NO: 4948 | |
| 24-30 | SEQ ID NO: 4936 | SEQ ID NO: 4933 | SEQ ID NO: 4952 | SEQ ID NO: 4949 | |
| 24-31 | SEQ ID NO: 4937 | SEQ ID NO: 4932 | SEQ ID NO: 4953 | SEQ ID NO: 4948 | |
| 24-32 | SEQ ID NO: 4937 | SEQ ID NO: 4933 | SEQ ID NO: 4953 | SEQ ID NO: 4949 | |

TABLE 64

| Protein ID | D1-Fc | D5-Fab | D4-Fab | D3-Fab | D6-Fab | D2-Fc |
|---|---|---|---|---|---|---|
| 24-01 | L234A/L235A/P329G | Ipilimumab | Pembrolizumab | Pembrolizumab | Ipilimumab | L234A/L235A/P329G |
| 24-02 | L234A/L235A/P329G | Ipilimumab | Pembrolizumab | Pembrolizumab | Ipilimumab | L234A/L235A/P329G |
| 24-03 | L234A/L235A/P329G | Ipilimumab | Pembrolizumab | Pembrolizumab | Ipilimumab | L234A/L235A/P329G |
| 24-04 | L234A/L235A/P329G | Ipilimumab | Pembrolizumab | Pembrolizumab | Ipilimumab | L234A/L235A/P329G |
| 24-05 | L234A/L235A/P329G | | Pembrolizumab | Pembrolizumab | Ipilimumab | L234A/L235A/P329G |
| 24-06 | L234A/L235A/P329G | | Pembrolizumab | Pembrolizumab | Ipilimumab | L234A/L235A/P329G |
| 24-07 | L234A/L235A/P329G | | Pembrolizumab | Pembrolizumab | Ipilimumab | L234A/L235A/P329G |
| 24-08 | L234A/L235A/P329G | | Pembrolizumab | Pembrolizumab | Ipilimumab | L234A/L235A/P329G |
| 24-09 | L234A/L235A/P329G | Pembrolizumab | Ipilimumab | Ipilimumab | Pembrolizumab | L234A/L235A/P329G |
| 24-10 | L234A/L235A/P329G | Pembrolizumab | Ipilimumab | Ipilimumab | Pembrolizumab | L234A/L235A/P329G |
| 24-11 | L234A/L235A/P329G | Pembrolizumab | Ipilimumab | Ipilimumab | Pembrolizumab | L234A/L235A/P329G |
| 24-12 | L234A/L235A/P329G | Pembrolizumab | Ipilimumab | Ipilimumab | Pembrolizumab | L234A/L235A/P329G |
| 24-13 | L234A/L235A/P329G | Ipilimumab | 388D4 | 388D4 | Ipilimumab | L234A/L235A/P329G |
| 24-14 | L234A/L235A/P329G | Ipilimumab | 388D4 | 388D4 | Ipilimumab | L234A/L235A/P329G |
| 24-15 | L234A/L235A/P329G | Ipilimumab | 388D4 | 388D4 | Ipilimumab | L234A/L235A/P329G |
| 24-16 | L234A/L235A/P329G | Ipilimumab | 388D4 | 388D4 | Ipilimumab | L234A/L235A/P329G |
| 24-17 | L234A/L235A/P329G | | 388D4 | 388D4 | Ipilimumab | L234A/L235A/P329G |
| 24-18 | L234A/L235A/P329G | | 388D4 | 388D4 | Ipilimumab | L234A/L235A/P329G |
| 24-19 | L234A/L235A/P329G | | 388D4 | 388D4 | Ipilimumab | L234A/L235A/P329G |
| 24-20 | L234A/L235A/P329G | | 388D4 | 388D4 | Ipilimumab | L234A/L235A/P329G |
| 24-21 | L234A/L235A/P329G | 388D4 | Ipilimumab | Ipilimumab | 388D4 | L234A/L235A/P329G |
| 24-22 | L234A/L235A/P329G | 388D4 | Ipilimumab | Ipilimumab | 388D4 | L234A/L235A/P329G |
| 24-23 | L234A/L235A/P329G | 388D4 | Ipilimumab | Ipilimumab | 388D4 | L234A/L235A/P329G |
| 24-24 | L234A/L235A/P329G | 388D4 | Ipilimumab | Ipilimumab | 388D4 | L234A/L235A/P329G |
| 24-25 | L234A/L235A/P329G | 244C8 | 388D4 | 388D4 | 244C8 | L234A/L235A/P329G |
| 24-26 | L234A/L235A/P329G | 244C8 | 388D4 | 388D4 | 244C8 | L234A/L235A/P329G |
| 24-27 | L234A/L235A/P329G | 244C8 | 388D4 | 388D4 | 244C8 | L234A/L235A/P329G |
| 24-28 | L234A/L235A/P329G | 244C8 | 388D4 | 388D4 | 244C8 | L234A/L235A/P329G |
| 24-29 | L234A/L235A/P329G | 388D4 | 244C8 | 244C8 | 388D4 | L234A/L235A/P329G |
| 24-30 | L234A/L235A/P329G | 388D4 | 244C8 | 244C8 | 388D4 | L234A/L235A/P329G |
| 24-31 | L234A/L235A/P329G | 388D4 | 244C8 | 244C8 | 388D4 | L234A/L235A/P329G |
| 24-32 | L234A/L235A/P329G | 388D4 | 244C8 | 244C8 | 388D4 | L234A/L235A/P329G |

TABLE 65

| Protein ID | D1-Fc Specificity | D5-Fab Specificity | D4-Fab Specificity | D3-Fab Specificity | D6-Fab Specificity | D2-Fc Specificity |
|---|---|---|---|---|---|---|
| 24-01 | FcgR silent | CTLA-4 | PD-1 | PD-1 | CTLA-4 | FcgR silent |
| 24-02 | FcgR silent | CTLA-4 | PD-1 | PD-1 | CTLA-4 | FcgR silent |

TABLE 65-continued

| Protein ID | D1-Fc Specificity | D5-Fab Specificity | D4-Fab Specificity | D3-Fab Specificity | D6-Fab Specificity | D2-Fc Specificity |
|---|---|---|---|---|---|---|
| 24-03 | FcgR silent | CTLA-4 | PD-1 | PD-1 | CTLA-4 | FcgR silent |
| 24-04 | FcgR silent | CTLA-4 | PD-1 | PD-1 | CTLA-4 | FcgR silent |
| 24-05 | FcgR silent | | PD-1 | PD-1 | CTLA-4 | FcgR silent |
| 24-06 | FcgR silent | | PD-1 | PD-1 | CTLA-4 | FcgR silent |
| 24-07 | FcgR silent | | PD-1 | PD-1 | CTLA-4 | FcgR silent |
| 24-08 | FcgR silent | | PD-1 | PD-1 | CTLA-4 | FcgR silent |
| 24-09 | FcgR silent | PD-1 | CTLA-4 | CTLA-4 | PD-1 | FcgR silent |
| 24-10 | FcgR silent | PD-1 | CTLA-4 | CTLA-4 | PD-1 | FcgR silent |
| 24-11 | FcgR silent | PD-1 | CTLA-4 | CTLA-4 | PD-1 | FcgR silent |
| 24-12 | FcgR silent | PD-1 | CTLA-4 | CTLA-4 | PD-1 | FcgR silent |
| 24-13 | FcgR silent | CTLA-4 | PD-1 | PD-1 | CTLA-4 | FcgR silent |
| 24-14 | FcgR silent | CTLA-4 | PD-1 | PD-1 | CTLA-4 | FcgR silent |
| 24-15 | FcgR silent | CTLA-4 | PD-1 | PD-1 | CTLA-4 | FcgR silent |
| 24-16 | FcgR silent | CTLA-4 | PD-1 | PD-1 | CTLA-4 | FcgR silent |
| 24-17 | FcgR silent | | PD-1 | PD-1 | CTLA-4 | FcgR silent |
| 24-18 | FcgR silent | | PD-1 | PD-1 | CTLA-4 | FcgR silent |
| 24-19 | FcgR silent | | PD-1 | PD-1 | CTLA-4 | FcgR silent |
| 24-20 | FcgR silent | | PD-1 | PD-1 | CTLA-4 | FcgR silent |
| 24-21 | FcgR silent | PD-1 | CTLA-4 | CTLA-4 | PD-1 | FcgR silent |
| 24-22 | FcgR silent | PD-1 | CTLA-4 | CTLA-4 | PD-1 | FcgR silent |
| 24-23 | FcgR silent | PD-1 | CTLA-4 | CTLA-4 | PD-1 | FcgR silent |
| 24-24 | FcgR silent | PD-1 | CTLA-4 | CTLA-4 | PD-1 | FcgR silent |
| 24-25 | FcgR silent | PD-1 (allosteric) | PD-1 | PD-1 | PD-1 (allosteric) | FcgR silent |
| 24-26 | FcgR silent | PD-1 (allosteric) | PD-1 | PD-1 | PD-1 (allosteric) | FcgR silent |
| 24-27 | FcgR silent | PD-1 (allosteric) | PD-1 | PD-1 | PD-1 (allosteric) | FcgR silent |
| 24-28 | FcgR silent | PD-1 (allosteric) | PD-1 | PD-1 | PD-1 (allosteric) | FcgR silent |
| 24-29 | FcgR silent | PD-1 | PD-1 (allosteric) | PD-1 (allosteric) | PD-1 | FcgR silent |
| 24-30 | FcgR silent | PD-1 | PD-1 (allosteric) | PD-1 (allosteric) | PD-1 | FcgR silent |
| 24-31 | FcgR silent | PD-1 | PD-1 (allosteric) | PD-1 (allosteric) | PD-1 | FcgR silent |
| 24-32 | FcgR silent | PD-1 | PD-1 (allosteric) | PD-1 (allosteric) | PD-1 | FcgR silent |

TABLE 66

| | H1 Chain | | H2 Chain | | L1 Chain | | L2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 24-01 | VH-CH1 | Q39K/S183E | VK-CH1 | Q38E/S183K | VK-CK | Q38E/V133K | VH-CK | Q39K/V133E |
| 24-02 | VH-CH2 | Q39K/S183E | VK-CH1 | Q38K/S183K | VK-CK | Q38E/V133K | VH-CK | Q39E/V133E |
| 24-03 | VH-CH1 | Q39E/S183E | VK-CH1 | Q38E/S183K | VK-CK | Q38K/V133K | VH-CK | Q39K/V133E |
| 24-04 | VH-CH1 | Q39E/S183E | VK-CH1 | Q38K/S183K | VK-CK | Q38K/V133K | VH-CK | Q39E/V133E |
| 24-05 | VH-CH1 | Q39K/S183E | VK-CH1 | Q38E/S183K | VK-CK | Q38E/V133K | VH-CK | Q39K/V133E |
| 24-06 | VH-CH1 | Q39K/S183E | VK-CH1 | Q38K/S183K | VK-CK | Q38E/V133K | VH-CK | Q39E/V133E |
| 24-07 | VH-CH1 | Q39E/S183E | VK-CH1 | Q38E/S183K | VK-CK | Q38K/V133K | VH-CK | Q39K/V133E |
| 24-08 | VH-CH1 | Q39E/S183E | VK-CH1 | Q38K/S183K | VK-CK | Q38K/V133K | VH-CK | Q39E/V133E |
| 24-09 | VH-CH1 | Q39K/S183E | VK-CH1 | Q38E/S183K | VK-CK | Q38E/V133K | VH-CK | Q39K/V133E |
| 24-10 | VH-CH1 | Q39K/S183E | VK-CH1 | Q38K/S183K | VK-CK | Q38E/V133K | VH-CK | Q39E/V133E |
| 24-11 | VH-CH1 | Q39E/S183E | VK-CH1 | Q38E/S183K | VK-CK | Q38K/V133K | VH-CK | Q39K/V133E |
| 24-12 | VH-CH1 | Q39E/S183E | VK-CH1 | Q38K/S183K | VK-CK | Q38K/V133K | VH-CK | Q39E/V133E |
| 24-13 | VH-CH1 | Q39K/S183E | VK-CH1 | Q38E/S183K | VK-CK | Q38E/V133K | VH-CK | Q39K/V133E |
| 24-14 | VH-CH1 | Q39K/S183E | VK-CH1 | Q38K/S183K | VK-CK | Q38E/V133K | VH-CK | Q39E/V133E |
| 24-15 | VH-CH1 | Q39E/S183E | VK-CH1 | Q38E/S183K | VK-CK | Q38K/V133K | VH-CK | Q39K/V133E |
| 24-16 | VH-CH1 | Q39E/S183E | VK-CH1 | Q38K/S183K | VK-CK | Q38K/V133K | VH-CK | Q39E/V133E |
| 24-17 | VH-CH1 | Q39K/S183E | VK-CH1 | Q38E/S183K | VK-CK | Q38E/V133K | VH-CK | Q39K/V133E |
| 24-18 | VH-CH1 | Q39K/S183E | VK-CH1 | Q38K/S183K | VK-CK | Q38E/V133K | VH-CK | Q39E/V133E |
| 24-19 | VH-CH1 | Q39E/S183E | VK-CH1 | Q38E/S183K | VK-CK | Q38K/V133K | VH-CK | Q39K/V133E |
| 24-20 | VH-CH1 | Q39E/S183E | VK-CH1 | Q38K/S183K | VK-CK | Q38K/V133K | VH-CK | Q39E/V133E |
| 24-21 | VH-CH1 | Q39K/S183E | VK-CH1 | Q38E/S183K | VK-CK | Q38E/V133K | VH-CK | Q39K/V133E |
| 24-22 | VH-CH1 | Q39K/S183E | VK-CH1 | Q38K/S183K | VK-CK | Q38E/V133K | VH-CK | Q39E/V133E |
| 24-23 | VH-CH1 | Q39E/S183E | VK-CH1 | Q38E/S183K | VK-CK | Q38K/V133K | VH-CK | Q39K/V133E |
| 24-24 | VH-CH1 | Q39E/S183E | VK-CH1 | Q38K/S183K | VK-CK | Q38K/V133K | VH-CK | Q39E/V133E |
| 24-25 | VH-CH1 | Q39K/S183E | VK-CH1 | Q38E/S183K | VK-CK | Q38E/V133K | VH-CK | Q39K/V133E |
| 24-26 | VH-CH1 | Q39K/S183E | VK-CH1 | Q38K/S183K | VK-CK | Q38E/V133K | VH-CK | Q39E/V133E |
| 24-27 | VH-CH1 | Q39E/S183E | VK-CH1 | Q38E/S183K | VK-CK | Q38K/V133K | VH-CK | Q39K/V133E |
| 24-28 | VH-CH1 | Q39E/S183E | VK-CH1 | Q38K/S183K | VK-CK | Q38K/V133K | VH-CK | Q39E/V133E |
| 24-29 | VH-CH1 | Q39K/S183E | VK-CH1 | Q38E/S183K | VK-CK | Q38E/V133K | VH-CK | Q39K/V133E |
| 24-30 | VH-CH1 | Q39K/S183E | VK-CH1 | Q38K/S183K | VK-CK | Q38E/V133K | VH-CK | Q39E/V133E |
| 24-31 | VH-CH1 | Q39E/S183E | VK-CH1 | Q38E/S183K | VK-CK | Q38K/V133K | VH-CK | Q39K/V133E |
| 24-32 | VH-CH1 | Q39E/S183E | VK-CH1 | Q38K/S183K | VK-CK | Q38K/V133K | VH-CK | Q39E/V133E |

Example 27—Tetravalent, Bispecific Tetrahedral Antibodies Comprising Two Distinct Fabs that Specifically Bind PD-1 and PD-L1

Tetrahedral antibodies were designed, expressed, and evaluated for their ability to act as checkpoint inhibitors for the treatment of cancer and other disease. This series of bispecific constructs employ VH and VL regions from pembrolizumab (anti-PD-1), 388D4 (anti-PD-1), atezolizumab (anti-PD-L1), and B6055 (anti-PD-L1) (Tables 67, 68). The various Fab pairings are pembrolizumab/atezolizumab, 388D4/atezolizumab, pembrolizumab/B6055, and 388D4/B6055 (all anti-PD-1/anti-PD-L1), each placed in either orientation with respect to D3/D4 and D5/D6 (Table 69). To optimize correct VH/VL pairing and to minimize VH/VL mispairing, V region exchange is combined with four different sets of charge pairs to ensure correct pairing of heavy and light chain V regions (Table 70). Additionally, to further facilitate purification of the correctly paired product by Protein A chromatography, the H1 chain incorporates the H435R/Y436F substitution. The constructs are then evaluated for their structural bispecificity by intact mass spectrometry as described in Example 18, and for their functional bispecificity using a variety of in vitro binding assays, cytotoxicity assays, and cytokine induction and release assays, and in vivo cancer efficacy models, known to one skilled in the art.

TABLE 67

| Protein ID | H1 Chain | H2 Chain | L1 Chain | L2 Chain |
|---|---|---|---|---|
| 25-01 | SEQ ID NO: 4955 | SEQ ID NO: 4956 | SEQ ID NO: 4971 | SEQ ID NO: 4972 |
| 25-02 | SEQ ID NO: 4955 | SEQ ID NO: 4957 | SEQ ID NO: 4971 | SEQ ID NO: 4973 |
| 25-03 | SEQ ID NO: 4958 | SEQ ID NO: 4956 | SEQ ID NO: 4974 | SEQ ID NO: 4972 |
| 25-04 | SEQ ID NO: 4958 | SEQ ID NO: 4957 | SEQ ID NO: 4974 | SEQ ID NO: 4973 |
| 25-05 | SEQ ID NO: 4959 | SEQ ID NO: 4960 | SEQ ID NO: 4975 | SEQ ID NO: 4976 |
| 25-06 | SEQ ID NO: 4959 | SEQ ID NO: 4961 | SEQ ID NO: 4975 | SEQ ID NO: 4977 |
| 25-07 | SEQ ID NO: 4962 | SEQ ID NO: 4960 | SEQ ID NO: 4978 | SEQ ID NO: 4976 |
| 25-08 | SEQ ID NO: 4962 | SEQ ID NO: 4961 | SEQ ID NO: 4978 | SEQ ID NO: 4977 |
| 25-09 | SEQ ID NO: 4963 | SEQ ID NO: 4956 | SEQ ID NO: 4979 | SEQ ID NO: 4972 |
| 25-10 | SEQ ID NO: 4963 | SEQ ID NO: 4957 | SEQ ID NO: 4979 | SEQ ID NO: 4973 |
| 25-11 | SEQ ID NO: 4964 | SEQ ID NO: 4956 | SEQ ID NO: 4980 | SEQ ID NO: 4972 |
| 25-12 | SEQ ID NO: 4964 | SEQ ID NO: 4957 | SEQ ID NO: 4980 | SEQ ID NO: 4973 |
| 25-13 | SEQ ID NO: 4959 | SEQ ID NO: 4965 | SEQ ID NO: 4975 | SEQ ID NO: 4981 |
| 25-14 | SEQ ID NO: 4959 | SEQ ID NO: 4966 | SEQ ID NO: 4975 | SEQ ID NO: 4982 |
| 25-15 | SEQ ID NO: 4962 | SEQ ID NO: 4965 | SEQ ID NO: 4978 | SEQ ID NO: 4981 |
| 25-16 | SEQ ID NO: 4962 | SEQ ID NO: 4966 | SEQ ID NO: 4978 | SEQ ID NO: 4982 |
| 25-17 | SEQ ID NO: 4955 | SEQ ID NO: 4967 | SEQ ID NO: 4971 | SEQ ID NO: 4983 |
| 25-18 | SEQ ID NO: 4955 | SEQ ID NO: 4968 | SEQ ID NO: 4971 | SEQ ID NO: 4984 |
| 25-19 | SEQ ID NO: 4958 | SEQ ID NO: 4967 | SEQ ID NO: 4974 | SEQ ID NO: 4983 |
| 25-20 | SEQ ID NO: 4958 | SEQ ID NO: 4968 | SEQ ID NO: 4974 | SEQ ID NO: 4984 |
| 25-21 | SEQ ID NO: 4969 | SEQ ID NO: 4960 | SEQ ID NO: 4985 | SEQ ID NO: 4976 |
| 25-22 | SEQ ID NO: 4969 | SEQ ID NO: 4961 | SEQ ID NO: 4985 | SEQ ID NO: 4977 |
| 25-23 | SEQ ID NO: 4970 | SEQ ID NO: 4960 | SEQ ID NO: 4986 | SEQ ID NO: 4976 |
| 25-24 | SEQ ID NO: 4970 | SEQ ID NO: 4961 | SEQ ID NO: 4986 | SEQ ID NO: 4977 |
| 25-25 | SEQ ID NO: 4963 | SEQ ID NO: 4967 | SEQ ID NO: 4979 | SEQ ID NO: 4983 |
| 25-26 | SEQ ID NO: 4963 | SEQ ID NO: 4968 | SEQ ID NO: 4979 | SEQ ID NO: 4984 |
| 25-27 | SEQ ID NO: 4964 | SEQ ID NO: 4967 | SEQ ID NO: 4980 | SEQ ID NO: 4983 |
| 25-28 | SEQ ID NO: 4964 | SEQ ID NO: 4968 | SEQ ID NO: 4980 | SEQ ID NO: 4984 |
| 25-29 | SEQ ID NO: 4969 | SEQ ID NO: 4965 | SEQ ID NO: 4985 | SEQ ID NO: 4981 |
| 25-30 | SEQ ID NO: 4969 | SEQ ID NO: 4966 | SEQ ID NO: 4985 | SEQ ID NO: 4982 |
| 25-31 | SEQ ID NO: 4970 | SEQ ID NO: 4965 | SEQ ID NO: 4986 | SEQ ID NO: 4981 |
| 25-32 | SEQ ID NO: 4970 | SEQ ID NO: 4966 | SEQ ID NO: 4986 | SEQ ID NO: 4982 |

TABLE 68

| Protein ID | D1-Fc | D5-Fab | D4-Fab | D3-Fab | D6-Fab | D2-Fc |
|---|---|---|---|---|---|---|
| 25-01 | L234A/L235A/P329 | Atezolizumab | Pembrolizuma | Pembrolizuma | Atezolizumab | L234A/L235A/P329 |
| 25-02 | L234A/L235A/P329 | Atezolizumab | Pembrolizuma | Pembrolizuma | Atezolizumab | L234A/L235A/P329 |
| 25-03 | L234A/L235A/P329 | Atezolizumab | Pembrolizuma | Pembrolizuma | Atezolizumab | L234A/L235A/P329 |
| 25-04 | L234A/L235A/P329 | Atezolizumab | Pembrolizuma | Pembrolizuma | Atezolizumab | L234A/L235A/P329 |
| 25-05 | L234A/L235A/P329 | Pembrolizuma | Atezolizumab | Atezolizumab | Pembrolizuma | L234A/L235A/P329 |
| 25-06 | L234A/L235A/P329 | Pembrolizuma | Atezolizumab | Atezolizumab | Pembrolizuma | L234A/L235A/P329 |
| 25-07 | L234A/L235A/P329 | Pembrolizuma | Atezolizumab | Atezolizumab | Pembrolizuma | L234A/L235A/P329 |
| 25-08 | L234A/L235A/P329 | Pembrolizuma | Atezolizumab | Atezolizumab | Pembrolizuma | L234A/L235A/P329 |
| 25-09 | L234A/L235A/P329 | Atezolizumab | 388D4 | 388D4 | Atezolizumab | L234A/L235A/P329 |
| 25-10 | L234A/L235A/P329 | Atezolizumab | 388D4 | 388D4 | Atezolizumab | L234A/L235A/P329 |
| 25-11 | L234A/L235A/P329 | Atezolizumab | 388D4 | 388D4 | Atezolizumab | L234A/L235A/P329 |
| 25-12 | L234A/L235A/P329 | Atezolizumab | 388D4 | 388D4 | Atezolizumab | L234A/L235A/P329 |
| 25-13 | L234A/L235A/P329 | 388D4 | Atezolizumab | Atezolizumab | 388D4 | L234A/L235A/P329 |
| 25-14 | L234A/L235A/P329 | 388D4 | Atezolizumab | Atezolizumab | 388D4 | L234A/L235A/P329 |
| 25-15 | L234A/L235A/P329 | 388D4 | Atezolizumab | Atezolizumab | 388D4 | L234A/L235A/P329 |
| 25-16 | L234A/L235A/P329 | 388D4 | Atezolizumab | Atezolizumab | 388D4 | L234A/L235A/P329 |
| 25-17 | L234A/L235A/P329 | B6055 | Pembrolizuma | Pembrolizuma | B6055 | L234A/L235A/P329 |
| 25-18 | L234A/L235A/P329 | B6055 | Pembrolizuma | Pembrolizuma | B6055 | L234A/L235A/P329 |

TABLE 68-continued

| Protein ID | D1-Fc | D5-Fab | D4-Fab | D3-Fab | D6-Fab | D2-Fc |
|---|---|---|---|---|---|---|
| 25-19 | L234A/L235A/P329 | B6055 | Pembrolizuma | Pembrolizuma | B6055 | L234A/L235A/P329 |
| 25-20 | L234A/L235A/P329 | B6055 | Pembrolizuma | Pembrolizuma | B6055 | L234A/L235A/P329 |
| 25-21 | L234A/L235A/P329 | Pembrolizuma | B6055 | B6055 | Pembrolizuma | L234A/L235A/P329 |
| 25-22 | L234A/L235A/P329 | Pembrolizuma | B6055 | B6055 | Pembrolizuma | L234A/L235A/P329 |
| 25-23 | L234A/L235A/P329 | Pembrolizuma | B6055 | B6055 | Pembrolizuma | L234A/L235A/P329 |
| 25-24 | L234A/L235A/P329 | Pembrolizuma | B6055 | B6055 | Pembrolizuma | L234A/L235A/P329 |
| 25-25 | L234A/L235A/P329 | B6055 | 388D4 | 388D4 | B6055 | L234A/L235A/P329 |
| 25-26 | L234A/L235A/P329 | B6055 | 388D4 | 388D4 | B6055 | L234A/L235A/P329 |
| 25-27 | L234A/L235A/P329 | B6055 | 388D4 | 388D4 | B6055 | L234A/L235A/P329 |
| 25-28 | L234A/L235A/P329 | B6055 | 388D4 | 388D4 | B6055 | L234A/L235A/P329 |
| 25-29 | L234A/L235A/P329 | 388D4 | B6055 | B6055 | 388D4 | L234A/L235A/P329 |
| 25-30 | L234A/L235A/P329 | 388D4 | B6055 | B6055 | 388D4 | L234A/L235A/P329 |
| 25-31 | L234A/L235A/P329 | 388D4 | B6055 | B6055 | 388D4 | L234A/L235A/P329 |
| 25-32 | L234A/L235A/P329 | 388D4 | B6055 | B6055 | 388D4 | L234A/L235A/P329 |

TABLE 69

| Protein ID | D1-Fc Specificity | D5-Fab Specificity | D4-Fab Specificity | D3-Fab Specificity | D6-Fab Specificity | D2-Fc Specificity |
|---|---|---|---|---|---|---|
| 25-01 | FcgR silent | PD-L1 | PD-1 | PD-1 | PD-L1 | FcgR silent |
| 25-02 | FcgR silent | PD-L1 | PD-1 | PD-1 | PD-L1 | FcgR silent |
| 25-03 | FcgR silent | PD-L1 | PD-1 | PD-1 | PD-L1 | FcgR silent |
| 25-04 | FcgR silent | PD-L1 | PD-1 | PD-1 | PD-L1 | FcgR silent |
| 25-05 | FcgR silent | PD-1 | PD-L1 | PD-L1 | PD-1 | FcgR silent |
| 25-06 | FcgR silent | PD-1 | PD-L1 | PD-L1 | PD-1 | FcgR silent |
| 25-07 | FcgR silent | PD-1 | PD-L1 | PD-L1 | PD-1 | FcgR silent |
| 25-08 | FcgR silent | PD-1 | PD-L1 | PD-L1 | PD-1 | FcgR silent |
| 25-09 | FcgR silent | PD-L1 | PD-1 | PD-1 | PD-L1 | FcgR silent |
| 25-10 | FcgR silent | PD-L1 | PD-1 | PD-1 | PD-L1 | FcgR silent |
| 25-11 | FcgR silent | PD-L1 | PD-1 | PD-1 | PD-L1 | FcgR silent |
| 25-12 | FcgR silent | PD-L1 | PD-1 | PD-1 | PD-L1 | FcgR silent |
| 25-13 | FcgR silent | PD-1 | PD-L1 | PD-L1 | PD-1 | FcgR silent |
| 25-14 | FcgR silent | PD-1 | PD-L1 | PD-L1 | PD-1 | FcgR silent |
| 25-15 | FcgR silent | PD-1 | PD-L1 | PD-L1 | PD-1 | FcgR silent |
| 25-16 | FcgR silent | PD-1 | PD-L1 | PD-L1 | PD-1 | FcgR silent |
| 25-17 | FcgR silent | PD-L1 | PD-1 | PD-1 | PD-L1 | FcgR silent |
| 25-18 | FcgR silent | PD-L1 | PD-1 | PD-1 | PD-L1 | FcgR silent |
| 25-19 | FcgR silent | PD-L1 | PD-1 | PD-1 | PD-L1 | FcgR silent |
| 25-20 | FcgR silent | PD-L1 | PD-1 | PD-1 | PD-L1 | FcgR silent |
| 25-21 | FcgR silent | PD-1 | PD-L1 | PD-L1 | PD-1 | FcgR silent |
| 25-22 | FcgR silent | PD-1 | PD-L1 | PD-L1 | PD-1 | FcgR silent |
| 25-23 | FcgR silent | PD-1 | PD-L1 | PD-L1 | PD-1 | FcgR silent |
| 25-24 | FcgR silent | PD-1 | PD-L1 | PD-L1 | PD-1 | FcgR silent |
| 25-25 | FcgR silent | PD-L1 | PD-1 | PD-1 | PD-L1 | FcgR silent |
| 25-26 | FcgR silent | PD-L1 | PD-1 | PD-1 | PD-L1 | FcgR silent |
| 25-27 | FcgR silent | PD-L1 | PD-1 | PD-1 | PD-L1 | FcgR silent |
| 25-28 | FcgR silent | PD-L1 | PD-1 | PD-1 | PD-L1 | FcgR silent |
| 25-29 | FcgR silent | PD-1 | PD-L1 | PD-L1 | PD-1 | FcgR silent |
| 25-30 | FcgR silent | PD-1 | PD-L1 | PD-L1 | PD-1 | FcgR silent |
| 25-31 | FcgR silent | PD-1 | PD-L1 | PD-L1 | PD-1 | FcgR silent |
| 25-32 | FcgR silent | PD-1 | PD-L1 | PD-L1 | PD-1 | FcgR silent |

TABLE 70

| | H1 Chain | | H2 Chain | | L1 Chain | | L2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 25-01 | VH-CH1 | Q39K/S183E | VK-CH1 | Q38E/S183K | VK-CK | Q38E/V133K | VH-CK | Q39K/V133E |
| 25-02 | VH-CH1 | Q39K/S183E | VK-CH1 | Q38K/S183K | VK-CK | Q38E/V133K | VH-CK | Q39E/V133E |
| 25-03 | VH-CH1 | Q39E/S183E | VK-CH1 | Q38E/S183K | VK-CK | Q38K/V133K | VH-CK | Q39K/V133E |
| 25-04 | VH-CH1 | Q39E/S183E | VK-CH1 | Q38K/S183K | VK-CK | Q38K/V133K | VH-CK | Q39E/V133E |
| 25-05 | VH-CH1 | Q39K/S183E | VK-CH1 | Q38E/S183K | VK-CK | Q38E/V133K | VH-CK | Q39K/V133E |
| 25-06 | VH-CH1 | Q39K/S183E | VK-CH1 | Q38K/S183K | VK-CK | Q38E/V133K | VH-CK | Q39E/V133E |
| 25-07 | VH-CH1 | Q39E/S183E | VK-CH1 | Q38E/S183K | VK-CK | Q38K/V133K | VH-CK | Q39K/V133E |
| 25-08 | VH-CH1 | Q39E/S183E | VK-CH1 | Q38K/S183K | VK-CK | Q38K/V133K | VH-CK | Q39E/V133E |

TABLE 70-continued

| | H1 Chain | | H2 Chain | | L1 Chain | | L2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 25-09 | VH-CH1 | Q39K/S183E | VK-CH1 | Q38E/S183K | VK-CK | Q38E/V133K | VH-CK | Q39K/V133E |
| 25-10 | VH-CH1 | Q39K/S183E | VK-CH1 | Q38K/S183K | VK-CK | Q38E/V133K | VH-CK | Q39E/V133E |
| 25-11 | VH-CH1 | Q39E/S183E | VK-CH1 | Q38E/S183K | VK-CK | Q38K/V133K | VH-CK | Q39K/V133E |
| 25-12 | VH-CH1 | Q39E/S183E | VK-CH1 | Q38K/S183K | VK-CK | Q38K/V133K | VH-CK | Q39E/V133E |
| 25-13 | VH-CH1 | Q39K/S183E | VK-CH1 | Q38E/S183K | VK-CK | Q38E/V133K | VH-CK | Q39K/V133E |
| 25-14 | VH-CH1 | Q39K/S183E | VK-CH1 | Q38K/S183K | VK-CK | Q38E/V133K | VH-CK | Q39E/V133E |
| 25-15 | VH-CH1 | Q39E/S183E | VK-CH1 | Q38E/S183K | VK-CK | Q38K/V133K | VH-CK | Q39K/V133E |
| 25-16 | VH-CH1 | Q39E/S183E | VK-CH1 | Q38K/S183K | VK-CK | Q38K/V133K | VH-CK | Q39E/V133E |
| 25-17 | VH-CH1 | Q39K/S183E | VK-CH1 | Q38E/S183K | VK-CK | Q38E/V133K | VH-CK | Q39K/V133E |
| 25-18 | VH-CH1 | Q39K/S183E | VK-CH1 | Q38K/S183K | VK-CK | Q38E/V133K | VH-CK | Q39E/V133E |
| 25-19 | VH-CH1 | Q39E/S183E | VK-CH1 | Q38E/S183K | VK-CK | Q38K/V133K | VH-CK | Q39K/V133E |
| 25-20 | VH-CH1 | Q39E/S183E | VK-CH1 | Q38K/S183K | VK-CK | Q38K/V133K | VH-CK | Q39E/V133E |
| 25-21 | VH-CH1 | Q39K/S183E | VK-CH1 | Q38E/S183K | VK-CK | Q38E/V133K | VH-CK | Q39K/V133E |
| 25-22 | VH-CH1 | Q39K/S183E | VK-CH1 | Q38K/S183K | VK-CK | Q38E/V133K | VH-CK | Q39E/V133E |
| 25-23 | VH-CH1 | Q39E/S183E | VK-CH1 | Q38E/S183K | VK-CK | Q38K/V133K | VH-CK | Q39K/V133E |
| 25-24 | VH-CH1 | Q39E/S183E | VK-CH1 | Q38K/S183K | VK-CK | Q38K/V133K | VH-CK | Q39E/V133E |
| 25-25 | VH-CH1 | Q39K/S183E | VK-CH1 | Q38E/S183K | VK-CK | Q38E/V133K | VH-CK | Q39K/V133E |
| 25-26 | VH-CH1 | Q39K/S183E | VK-CH1 | Q38K/S183K | VK-CK | Q38E/V133K | VH-CK | Q39E/V133E |
| 25-27 | VH-CH1 | Q39E/S183E | VK-CH1 | Q38E/S183K | VK-CK | Q38K/V133K | VH-CK | Q39K/V133E |
| 25-28 | VH-CH1 | Q39E/S183E | VK-CH1 | Q38K/S183K | VK-CK | Q38K/V133K | VH-CK | Q39E/V133E |
| 25-29 | VH-CH1 | Q39K/S183E | VK-CH1 | Q38E/S183K | VK-CK | Q38E/V133K | VH-CK | Q39K/V133E |
| 25-30 | VH-CH1 | Q39K/S183E | VK-CH1 | Q38K/S183K | VK-CK | Q38E/V133K | VH-CK | Q39E/V133E |
| 25-31 | VH-CH1 | Q39E/S183E | VK-CH1 | Q38E/S183K | VK-CK | Q38K/V133K | VH-CK | Q39K/V133E |
| 25-32 | VH-CH1 | Q39E/S183E | VK-CH1 | Q38K/S183K | VK-CK | Q38K/V133K | VH-CK | Q39E/V133E |

Example 28—Tetravalent, Bispecific Tetrahedral Antibodies Comprising Two Distinct Fabs that Specifically Bind ERBB2, EGFR, PD-1, and/or PD-L1

Tetrahedral antibodies were designed, expressed, and evaluated for their ability to act as tumor-targeted checkpoint inhibitors for the treatment of cancer and other disease. This series of bispecific constructs employ VH and VL regions from trastuzumab (anti-ERBB2), pertuzumab (anti-ERBB2), cetuximab (anti-EGFR), 388D4 (anti-PD-1), and B6055 (anti-PD-L1) (Tables 71, 72). The various tumor-targeted checkpoint inhibitor Fab pairings are trastuzumab/388D4, cetuximab/388D4, trastuzumab/B6055, and cetuximab/B6055, each placed in either orientation with respect to D3/D4 and D5/D6 (Table 73). In addition, several tumor-specific Fab pairings are evaluated: trastuzumab/pertuzumab, cetuximab/pertuzumab, and trastuzumab/cetuximab, each placed in either orientation with respect to D3/D4 and D5/D6 (Table 73). To optimize correct VH/VL pairing and to minimize VH/VL mispairing, V region exchange is combined with four different sets of charge pairs to ensure correct pairing of heavy and light chain V regions (Table 74). Additionally, to further facilitate purification of the correctly paired product by Protein A chromatography, the H1 chain incorporates the H435R/Y436F substitution. The constructs are then evaluated for their structural bispecificity by intact mass spectrometry as described in Example 18, and for their functional bispecificity using a variety of in vitro binding assays, checkpoint inhibition assays, cytotoxicity assays, and cytokine induction and release assays, and in vivo cancer efficacy models, known to one skilled in the art.

TABLE 71

| Protein ID | H1 Chain | H2 Chain | L1 Chain | L2 Chain |
|---|---|---|---|---|
| 26-01 | SEQ ID NO: 4987 | SEQ ID NO: 4988 | SEQ ID NO: 5015 | SEQ ID NO: 5016 |
| 26-02 | SEQ ID NO: 4987 | SEQ ID NO: 4989 | SEQ ID NO: 5015 | SEQ ID NO: 5017 |
| 26-03 | SEQ ID NO: 4990 | SEQ ID NO: 4988 | SEQ ID NO: 5018 | SEQ ID NO: 5016 |
| 26-04 | SEQ ID NO: 4990 | SEQ ID NO: 4989 | SEQ ID NO: 5018 | SEQ ID NO: 5017 |
| 26-05 | SEQ ID NO: 4991 | SEQ ID NO: 4992 | SEQ ID NO: 5019 | SEQ ID NO: 5020 |
| 26-06 | SEQ ID NO: 4991 | SEQ ID NO: 4993 | SEQ ID NO: 5019 | SEQ ID NO: 5021 |
| 26-07 | SEQ ID NO: 4994 | SEQ ID NO: 4992 | SEQ ID NO: 5022 | SEQ ID NO: 5020 |
| 26-08 | SEQ ID NO: 4994 | SEQ ID NO: 4993 | SEQ ID NO: 5022 | SEQ ID NO: 5021 |
| 26-09 | SEQ ID NO: 4995 | SEQ ID NO: 4988 | SEQ ID NO: 5023 | SEQ ID NO: 5016 |
| 26-10 | SEQ ID NO: 4995 | SEQ ID NO: 4989 | SEQ ID NO: 5023 | SEQ ID NO: 5017 |
| 26-11 | SEQ ID NO: 4996 | SEQ ID NO: 4988 | SEQ ID NO: 5024 | SEQ ID NO: 5016 |
| 26-12 | SEQ ID NO: 4996 | SEQ ID NO: 4989 | SEQ ID NO: 5024 | SEQ ID NO: 5017 |
| 26-13 | SEQ ID NO: 4991 | SEQ ID NO: 4997 | SEQ ID NO: 5019 | SEQ ID NO: 5025 |
| 26-14 | SEQ ID NO: 4991 | SEQ ID NO: 4998 | SEQ ID NO: 5019 | SEQ ID NO: 5026 |
| 26-15 | SEQ ID NO: 4994 | SEQ ID NO: 4997 | SEQ ID NO: 5022 | SEQ ID NO: 5025 |
| 26-16 | SEQ ID NO: 4994 | SEQ ID NO: 4998 | SEQ ID NO: 5022 | SEQ ID NO: 5026 |
| 26-17 | SEQ ID NO: 4999 | SEQ ID NO: 5000 | SEQ ID NO: 5015 | SEQ ID NO: 5027 |
| 26-18 | SEQ ID NO: 4999 | SEQ ID NO: 5001 | SEQ ID NO: 5015 | SEQ ID NO: 5028 |
| 26-19 | SEQ ID NO: 5002 | SEQ ID NO: 5000 | SEQ ID NO: 5018 | SEQ ID NO: 5027 |
| 26-20 | SEQ ID NO: 5002 | SEQ ID NO: 5001 | SEQ ID NO: 5018 | SEQ ID NO: 5028 |
| 26-21 | SEQ ID NO: 5003 | SEQ ID NO: 5004 | SEQ ID NO: 5029 | SEQ ID NO: 5020 |
| 26-22 | SEQ ID NO: 5003 | SEQ ID NO: 5005 | SEQ ID NO: 5029 | SEQ ID NO: 5021 |
| 26-23 | SEQ ID NO: 5006 | SEQ ID NO: 5004 | SEQ ID NO: 5030 | SEQ ID NO: 5020 |

TABLE 71-continued

| Protein ID | H1 Chain | H2 Chain | L1 Chain | L2 Chain |
|---|---|---|---|---|
| 26-24 | SEQ ID NO: 5006 | SEQ ID NO: 5005 | SEQ ID NO: 5030 | SEQ ID NO: 5021 |
| 26-25 | SEQ ID NO: 5007 | SEQ ID NO: 5000 | SEQ ID NO: 5023 | SEQ ID NO: 5027 |
| 26-26 | SEQ ID NO: 5007 | SEQ ID NO: 5001 | SEQ ID NO: 5023 | SEQ ID NO: 5028 |
| 26-27 | SEQ ID NO: 5008 | SEQ ID NO: 5000 | SEQ ID NO: 5024 | SEQ ID NO: 5027 |
| 26-28 | SEQ ID NO: 5008 | SEQ ID NO: 5001 | SEQ ID NO: 5024 | SEQ ID NO: 5028 |
| 26-29 | SEQ ID NO: 5003 | SEQ ID NO: 5009 | SEQ ID NO: 5029 | SEQ ID NO: 5025 |
| 26-30 | SEQ ID NO: 5003 | SEQ ID NO: 5010 | SEQ ID NO: 5029 | SEQ ID NO: 5026 |
| 26-31 | SEQ ID NO: 5006 | SEQ ID NO: 5009 | SEQ ID NO: 5030 | SEQ ID NO: 5025 |
| 26-32 | SEQ ID NO: 5006 | SEQ ID NO: 5010 | SEQ ID NO: 5030 | SEQ ID NO: 5026 |
| 26-33 | SEQ ID NO: 4999 | SEQ ID NO: 5011 | SEQ ID NO: 5015 | SEQ ID NO: 5031 |
| 26-34 | SEQ ID NO: 4999 | SEQ ID NO: 5012 | SEQ ID NO: 5015 | SEQ ID NO: 5032 |
| 26-35 | SEQ ID NO: 5002 | SEQ ID NO: 5011 | SEQ ID NO: 5018 | SEQ ID NO: 5031 |
| 26-36 | SEQ ID NO: 5002 | SEQ ID NO: 5012 | SEQ ID NO: 5018 | SEQ ID NO: 5032 |
| 26-37 | SEQ ID NO: 5013 | SEQ ID NO: 5004 | SEQ ID NO: 5033 | SEQ ID NO: 5020 |
| 26-38 | SEQ ID NO: 5013 | SEQ ID NO: 5005 | SEQ ID NO: 5033 | SEQ ID NO: 5021 |
| 26-39 | SEQ ID NO: 5014 | SEQ ID NO: 5004 | SEQ ID NO: 5034 | SEQ ID NO: 5020 |
| 26-40 | SEQ ID NO: 5014 | SEQ ID NO: 5005 | SEQ ID NO: 5034 | SEQ ID NO: 5021 |
| 26-41 | SEQ ID NO: 5007 | SEQ ID NO: 5011 | SEQ ID NO: 5023 | SEQ ID NO: 5031 |
| 26-42 | SEQ ID NO: 5007 | SEQ ID NO: 5012 | SEQ ID NO: 5023 | SEQ ID NO: 5032 |
| 26-43 | SEQ ID NO: 5008 | SEQ ID NO: 5011 | SEQ ID NO: 5024 | SEQ ID NO: 5031 |
| 26-44 | SEQ ID NO: 5008 | SEQ ID NO: 5012 | SEQ ID NO: 5024 | SEQ ID NO: 5032 |
| 26-45 | SEQ ID NO: 5013 | SEQ ID NO: 5009 | SEQ ID NO: 5033 | SEQ ID NO: 5025 |
| 26-46 | SEQ ID NO: 5013 | SEQ ID NO: 5010 | SEQ ID NO: 5033 | SEQ ID NO: 5026 |
| 26-47 | SEQ ID NO: 5014 | SEQ ID NO: 5009 | SEQ ID NO: 5034 | SEQ ID NO: 5025 |
| 26-48 | SEQ ID NO: 5014 | SEQ ID NO: 5010 | SEQ ID NO: 5034 | SEQ ID NO: 5026 |
| 26-49 | SEQ ID NO: 4987 | SEQ ID NO: 4997 | SEQ ID NO: 5015 | SEQ ID NO: 5025 |
| 26-50 | SEQ ID NO: 4987 | SEQ ID NO: 4998 | SEQ ID NO: 5015 | SEQ ID NO: 5026 |
| 26-51 | SEQ ID NO: 4990 | SEQ ID NO: 4997 | SEQ ID NO: 5018 | SEQ ID NO: 5025 |
| 26-52 | SEQ ID NO: 4990 | SEQ ID NO: 4998 | SEQ ID NO: 5018 | SEQ ID NO: 5026 |
| 26-53 | SEQ ID NO: 4995 | SEQ ID NO: 4992 | SEQ ID NO: 5023 | SEQ ID NO: 5020 |
| 26-54 | SEQ ID NO: 4995 | SEQ ID NO: 4993 | SEQ ID NO: 5023 | SEQ ID NO: 5021 |
| 26-55 | SEQ ID NO: 4996 | SEQ ID NO: 4992 | SEQ ID NO: 5024 | SEQ ID NO: 5020 |
| 26-56 | SEQ ID NO: 4996 | SEQ ID NO: 4993 | SEQ ID NO: 5024 | SEQ ID NO: 5021 |

TABLE 72

| Protein ID | D1-Fc | D5-Fab | D4-Fab | D3-Fab | D6-Fab | D2-Fc |
|---|---|---|---|---|---|---|
| 26-01 | wild-type | Pertuzumab | Trastuzumab | Trastuzumab | Pertuzumab | wild-type |
| 26-02 | wild-type | Pertuzumab | Trastuzumab | Trastuzumab | Pertuzumab | wild-type |
| 26-03 | wild-type | Pertuzumab | Trastuzumab | Trastuzumab | Pertuzumab | wild-type |
| 26-04 | wild-type | Pertuzumab | Trastuzumab | Trastuzumab | Pertuzumab | wild-type |
| 26-05 | wild-type | Trastuzumab | Pertuzumab | Pertuzumab | Trastuzumab | wild-type |
| 26-06 | wild-type | Trastuzumab | Pertuzumab | Pertuzumab | Trastuzumab | wild-type |
| 26-07 | wild-type | Trastuzumab | Pertuzumab | Pertuzumab | Trastuzumab | wild-type |
| 26-08 | wild-type | Trastuzumab | Pertuzumab | Pertuzumab | Trastuzumab | wild-type |
| 26-09 | wild-type | Pertuzumab | Cetuximab | Cetuximab | Pertuzumab | wild-type |
| 26-10 | wild-type | Pertuzumab | Cetuximab | Cetuximab | Pertuzumab | wild-type |
| 26-11 | wild-type | Pertuzumab | Cetuximab | Cetuximab | Pertuzumab | wild-type |
| 26-12 | wild-type | Pertuzumab | Cetuximab | Cetuximab | Pertuzumab | wild-type |
| 26-13 | wild-type | Cetuximab | Pertuzumab | Pertuzumab | Cetuximab | wild-type |
| 26-14 | wild-type | Cetuximab | Pertuzumab | Pertuzumab | Cetuximab | wild-type |
| 26-15 | wild-type | Cetuximab | Pertuzumab | Pertuzumab | Cetuximab | wild-type |
| 26-16 | wild-type | Cetuximab | Pertuzumab | Pertuzumab | Cetuximab | wild-type |
| 26-17 | L234A/L235A/P329G | 388D4 | Trastuzumab | Trastuzumab | 388D4 | L234A/L235A/P329G |
| 26-18 | L234A/L235A/P329G | 388D4 | Trastuzumab | Trastuzumab | 388D4 | L234A/L235A/P329G |
| 26-19 | L234A/L235A/P329G | 388D4 | Trastuzumab | Trastuzumab | 388D4 | L234A/L235A/P329G |
| 26-20 | L234A/L235A/P329G | 388D4 | Trastuzumab | Trastuzumab | 388D4 | L234A/L235A/P329G |
| 26-21 | L234A/L235A/P329G | Trastuzumab | 388D4 | 388D4 | Trastuzumab | L234A/L235A/P329G |
| 26-22 | L234A/L235A/P329G | Trastuzumab | 388D4 | 388D4 | Trastuzumab | L234A/L235A/P329G |
| 26-23 | L234A/L235A/P329G | Trastuzumab | 388D4 | 388D4 | Trastuzumab | L234A/L235A/P329G |
| 26-24 | L234A/L235A/P329G | Trastuzumab | 388D4 | 388D4 | Trastuzumab | L234A/L235A/P329G |
| 26-25 | L234A/L235A/P329G | 388D4 | Cetuximab | Cetuximab | 388D4 | L234A/L235A/P329G |
| 26-26 | L234A/L235A/P329G | 388D4 | Cetuximab | Cetuximab | 388D4 | L234A/L235A/P329G |
| 26-27 | L234A/L235A/P329G | 388D4 | Cetuximab | Cetuximab | 388D4 | L234A/L235A/P329G |
| 26-28 | L234A/L235A/P329G | 388D4 | Cetuximab | Cetuximab | 388D4 | L234A/L235A/P329G |
| 26-29 | L234A/L235A/P329G | Cetuximab | 388D4 | 388D4 | Cetuximab | L234A/L235A/P329G |
| 26-30 | L234A/L235A/P329G | Cetuximab | 388D4 | 388D4 | Cetuximab | L234A/L235A/P329G |
| 26-31 | L234A/L235A/P329G | Cetuximab | 388D4 | 388D4 | Cetuximab | L234A/L235A/P329G |
| 26-32 | L234A/L235A/P329G | Cetuximab | 388D4 | 388D4 | Cetuximab | L234A/L235A/P329G |
| 26-33 | L234A/L235A/P329G | B6055 | Trastuzumab | Trastuzumab | B6055 | L234A/L235A/P329G |
| 26-34 | L234A/L235A/P329G | B6055 | Trastuzumab | Trastuzumab | B6055 | L234A/L235A/P329G |
| 26-35 | L234A/L235A/P329G | B6055 | Trastuzumab | Trastuzumab | B6055 | L234A/L235A/P329G |
| 26-36 | L234A/L235A/P329G | B6055 | Trastuzumab | Trastuzumab | B6055 | L234A/L235A/P329G |

TABLE 72-continued

| Protein ID | D1-Fc | D5-Fab | D4-Fab | D3-Fab | D6-Fab | D2-Fc |
|---|---|---|---|---|---|---|
| 26-37 | L234A/L235A/P329G | Trastuzumab | B6055 | B6055 | Trastuzumab | L234A/L235A/P329G |
| 26-38 | L234A/L235A/P329G | Trastuzumab | B6055 | B6055 | Trastuzumab | L234A/L235A/P329G |
| 26-39 | L234A/L235A/P329G | Trastuzumab | B6055 | B6055 | Trastuzumab | L234A/L235A/P329G |
| 26-40 | L234A/L235A/P329G | Trastuzumab | B6055 | B6055 | Trastuzumab | L234A/L235A/P329G |
| 26-41 | L234A/L235A/P329G | B6055 | Cetuximab | Cetuximab | B6055 | L234A/L235A/P329G |
| 26-42 | L234A/L235A/P329G | B6055 | Cetuximab | Cetuximab | B6055 | L234A/L235A/P329G |
| 26-43 | L234A/L235A/P329G | B6055 | Cetuximab | Cetuximab | B6055 | L234A/L235A/P329G |
| 26-44 | L234A/L235A/P329G | B6055 | Cetuximab | Cetuximab | B6055 | L234A/L235A/P329G |
| 26-45 | L234A/L235A/P329G | Cetuximab | B6055 | B6055 | Cetuximab | L234A/L235A/P329G |
| 26-46 | L234A/L235A/P329G | Cetuximab | B6055 | B6055 | Cetuximab | L234A/L235A/P329G |
| 26-47 | L234A/L235A/P329G | Cetuximab | B6055 | B6055 | Cetuximab | L234A/L235A/P329G |
| 26-48 | L234A/L235A/P329G | Cetuximab | B6055 | B6055 | Cetuximab | L234A/L235A/P329G |
| 26-49 | wild-type | Cetuximab | Trastuzumab | Trastuzumab | Cetuximab | wild-type |
| 26-50 | wild-type | Cetuximab | Trastuzumab | Trastuzumab | Cetuximab | wild-type |
| 26-51 | wild-type | Cetuximab | Trastuzumab | Trastuzumab | Cetuximab | wild-type |
| 26-52 | wild-type | Cetuximab | Trastuzumab | Trastuzumab | Cetuximab | wild-type |
| 26-53 | wild-type | Trastuzumab | Cetuximab | Cetuximab | Trastuzumab | wild-type |
| 26-54 | wild-type | Trastuzumab | Cetuximab | Cetuximab | Trastuzumab | wild-type |
| 26-55 | wild-type | Trastuzumab | Cetuximab | Cetuximab | Trastuzumab | wild-type |
| 26-56 | wild-type | Trastuzumab | Cetuximab | Cetuximab | Trastuzumab | wild-type |

TABLE 73

| Protein ID | D1-Fc Specificity | D5-Fab Specificity | D4-Fab Specificity | D3-Fab Specificity | D6-Fab Specificity | D2-Fc Specificity |
|---|---|---|---|---|---|---|
| 26-01 | FcgR | ERBB2 (II) | ERBB2 (I) | ERBB2 (1) | ERBB2 (II) | FcgR |
| 26-02 | FcgR | ERBB2 (II) | ERBB2 (I) | ERBB2 (1) | ERBB2 (II) | FcgR |
| 26-03 | FcgR | ERBB2 (II) | ERBB2 (I) | ERBB2 (1) | ERBB2 (II) | FcgR |
| 26-04 | FcgR | ERBB2 (II) | ERBB2 (I) | ERBB2 (1) | ERBB2 (II) | FcgR |
| 26-05 | FcgR | ERBB2 (I) | ERBB2 (II) | ERBB2 (II) | ERBB2 (I) | FcgR |
| 26-06 | FcgR | ERBB2 (I) | ERBB2 (II) | ERBB2 (II) | ERBB2 (I) | FcgR |
| 26-07 | FcgR | ERBB2 (I) | ERBB2 (II) | ERBB2 (II) | ERBB2 (I) | FcgR |
| 26-08 | FcgR | ERBB2 (I) | ERBB2 (II) | ERBB2 (II) | ERBB2 (I) | FcgR |
| 26-09 | FcgR | ERBB2 (II) | EGFR | EGFR | ERBB2 (II) | FcgR |
| 26-10 | FcgR | ERBB2 (II) | EGFR | EGFR | ERBB2 (II) | FcgR |
| 26-11 | FcgR | ERBB2 (II) | EGFR | EGFR | ERBB2 (II) | FcgR |
| 26-12 | FcgR | ERBB2 (II) | EGFR | EGFR | ERBB2 (II) | FcgR |
| 26-13 | FcgR | EGFR | ERBB2 (II) | ERBB2 (II) | EGFR | FcgR |
| 26-14 | FcgR | EGFR | ERBB2 (II) | ERBB2 (II) | EGFR | FcgR |
| 26-15 | FcgR | EGFR | ERBB2 (II) | ERBB2 (II) | EGFR | FcgR |
| 26-16 | FcgR | EGFR | ERBB2 (II) | ERBB2 (II) | EGFR | FcgR |
| 26-17 | FcgR silent | PD-1 | ERBB2 (I) | ERBB2 (1) | PD-1 | FcgR silent |
| 26-18 | FcgR silent | PD-1 | ERBB2 (I) | ERBB2 (1) | PD-1 | FcgR silent |
| 26-19 | FcgR silent | PD-1 | ERBB2 (I) | ERBB2 (1) | PD-1 | FcgR silent |
| 26-20 | FcgR silent | PD-1 | ERBB2 (I) | ERBB2 (1) | PD-1 | FcgR silent |
| 26-21 | FcgR silent | ERBB2 (I) | PD-1 | PD-1 | ERBB2 (I) | FcgR silent |
| 26-22 | FcgR silent | ERBB2 (I) | PD-1 | PD-1 | ERBB2 (I) | FcgR silent |
| 26-23 | FcgR silent | ERBB2 (I) | PD-1 | PD-1 | ERBB2 (I) | FcgR silent |
| 26-24 | FcgR silent | ERBB2 (I) | PD-1 | PD-1 | ERBB2 (I) | FcgR silent |
| 26-25 | FcgR silent | PD-1 | EGFR | EGFR | PD-1 | FcgR silent |
| 26-26 | FcgR silent | PD-1 | EGFR | EGFR | PD-1 | FcgR silent |
| 26-27 | FcgR silent | PD-1 | EGFR | EGFR | PD-1 | FcgR silent |
| 26-28 | FcgR silent | PD-1 | EGFR | EGFR | PD-1 | FcgR silent |
| 26-29 | FcgR silent | EGFR | PD-1 | PD-1 | EGFR | FcgR silent |
| 26-30 | FcgR silent | EGFR | PD-1 | PD-1 | EGFR | FcgR silent |
| 26-31 | FcgR silent | EGFR | PD-1 | PD-1 | EGFR | FcgR silent |
| 26-32 | FcgR silent | EGFR | PD-1 | PD-1 | EGFR | FcgR silent |
| 26-33 | FcgR silent | PD-L1 | ERBB2 (I) | ERBB2 (1) | PD-L1 | FcgR silent |
| 26-34 | FcgR silent | PD-L1 | ERBB2 (I) | ERBB2 (1) | PD-L1 | FcgR silent |
| 26-35 | FcgR silent | PD-L1 | ERBB2 (I) | ERBB2 (1) | PD-L1 | FcgR silent |
| 26-36 | FcgR silent | PD-L1 | ERBB2 (I) | ERBB2 (1) | PD-L1 | FcgR silent |
| 26-37 | FcgR silent | ERBB2 (I) | PD-L1 | PD-L1 | ERBB2 (I) | FcgR silent |
| 26-38 | FcgR silent | ERBB2 (I) | PD-L1 | PD-L1 | ERBB2 (I) | FcgR silent |
| 26-39 | FcgR silent | ERBB2 (I) | PD-L1 | PD-L1 | ERBB2 (I) | FcgR silent |
| 26-40 | FcgR silent | ERBB2 (I) | PD-L1 | PD-L1 | ERBB2 (I) | FcgR silent |
| 26-41 | FcgR silent | PD-L1 | EGFR | EGFR | PD-L1 | FcgR silent |
| 26-42 | FcgR silent | PD-L1 | EGFR | EGFR | PD-L1 | FcgR silent |
| 26-43 | FcgR silent | PD-L1 | EGFR | EGFR | PD-L1 | FcgR silent |
| 26-44 | FcgR silent | PD-L1 | EGFR | EGFR | PD-L1 | FcgR silent |
| 26-45 | FcgR silent | EGFR | PD-L1 | PD-L1 | EGFR | FcgR silent |
| 26-46 | FcgR silent | EGFR | PD-L1 | PD-L1 | EGFR | FcgR silent |
| 26-47 | FcgR silent | EGFR | PD-L1 | PD-L1 | EGFR | FcgR silent |
| 26-48 | FcgR silent | EGFR | PD-L1 | PD-L1 | EGFR | FcgR silent |

TABLE 73-continued

| Protein ID | D1-Fc Specificity | D5-Fab Specificity | D4-Fab Specificity | D3-Fab Specificity | D6-Fab Specificity | D2-Fc Specificity |
|---|---|---|---|---|---|---|
| 26-49 | FcgR | α-EGFR | α-ERBB2 (I) | α-ERBB2 (I) | α-EGFR | FcgR |
| 26-50 | FcgR | α-EGFR | α-ERBB2 (I) | α-ERBB2 (I) | α-EGFR | FcgR |
| 26-51 | FcgR | α-EGFR | α-ERBB2 (I) | α-ERBB2 (I) | α-EGFR | FcgR |
| 26-52 | FcgR | α-EGFR | α-ERBB2 (I) | α-ERBB2 (I) | α-EGFR | FcgR |
| 26-53 | FcgR | α-ERBB2 (I) | α-EGFR | α-EGFR | α-ERBB2 (I) | FcgR |
| 26-54 | FcgR | α-ERBB2 (I) | α-EGFR | α-EGFR | α-ERBB2 (I) | FcgR |
| 26-55 | FcgR | α-ERBB2 (I) | α-EGFR | α-EGFR | α-ERBB2 (I) | FcgR |
| 26-56 | FcgR | α-ERBB2 (I) | α-EGFR | α-EGFR | α-ERBB2 (I) | FcgR |

TABLE 74

| | H1 Chain | | H2 Chain | | L1 Chain | | L2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 26-01 | VH-CH1 | Q39K/S183E | VK-CH1 | Q38E/S183K | VK-CK | Q38E/V133K | VH-CK | Q39K/V133E |
| 26-02 | VH-CH1 | Q39K/S183E | VK-CH1 | Q38K/S183K | VK-CK | Q38E/V133K | VH-CK | Q39E/V133E |
| 26-03 | VH-CH1 | Q39E/S183E | VK-CH1 | Q38E/S183K | VK-CK | Q38K/V133K | VH-CK | Q39K/V133E |
| 26-04 | VH-CH1 | Q39E/S183E | VK-CH1 | Q38K/S183K | VK-CK | Q38K/V133K | VH-CK | Q39E/V133E |
| 26-05 | VH-CH1 | Q39K/S183E | VK-CH1 | Q38E/S183K | VK-CK | Q38E/V133K | VH-CK | Q39K/V133E |
| 26-06 | VH-CH1 | Q39K/S183E | VK-CH1 | Q38K/S183K | VK-CK | Q38E/V133K | VH-CK | Q39E/V133E |
| 26-07 | VH-CH1 | Q39E/S183E | VK-CH1 | Q38E/S183K | VK-CK | Q38K/V133K | VH-CK | Q39K/V133E |
| 26-08 | VH-CH1 | Q39E/S183E | VK-CH1 | Q38K/S183K | VK-CK | Q38K/V133K | VH-CK | Q39E/V133E |
| 26-09 | VH-CH1 | Q39K/S183E | VK-CH1 | Q38E/S183K | VK-CK | Q38E/V133K | VH-CK | Q39K/V133E |
| 26-10 | VH-CH1 | Q39K/S183E | VK-CH1 | Q38K/S183K | VK-CK | Q38E/V133K | VH-CK | Q39E/V133E |
| 26-11 | VH-CH1 | Q39E/S183E | VK-CH1 | Q38E/S183K | VK-CK | Q38K/V133K | VH-CK | Q39K/V133E |
| 26-12 | VH-CH1 | Q39E/S183E | VK-CH1 | Q38K/S183K | VK-CK | Q38K/V133K | VH-CK | Q39E/V133E |
| 26-13 | VH-CH1 | Q39K/S183E | VK-CH1 | Q38E/S183K | VK-CK | Q38E/V133K | VH-CK | Q39K/V133E |
| 26-14 | VH-CH1 | Q39K/S183E | VK-CH1 | Q38K/S183K | VK-CK | Q38E/V133K | VH-CK | Q39E/V133E |
| 26-15 | VH-CH1 | Q39E/S183E | VK-CH1 | Q38E/S183K | VK-CK | Q38K/V133K | VH-CK | Q39K/V133E |
| 26-16 | VH-CH1 | Q39E/S183E | VK-CH1 | Q38K/S183K | VK-CK | Q38K/V133K | VH-CK | Q39E/V133E |
| 26-17 | VH-CH1 | Q39K/S183E | VK-CH1 | Q38E/S183K | VK-CK | Q38E/V133K | VH-CK | Q39K/V133E |
| 26-18 | VH-CH1 | Q39K/S183E | VK-CH1 | Q38K/S183K | VK-CK | Q38E/V133K | VH-CK | Q39E/V133E |
| 26-19 | VH-CH1 | Q39E/S183E | VK-CH1 | Q38E/S183K | VK-CK | Q38K/V133K | VH-CK | Q39K/V133E |
| 26-20 | VH-CH1 | Q39E/S183E | VK-CH1 | Q38K/S183K | VK-CK | Q38K/V133K | VH-CK | Q39E/V133E |
| 26-21 | VH-CH1 | Q39K/S183E | VK-CH1 | Q38E/S183K | VK-CK | Q38E/V133K | VH-CK | Q39K/V133E |
| 26-22 | VH-CH1 | Q39K/S183E | VK-CH1 | Q38K/S183K | VK-CK | Q38E/V133K | VH-CK | Q39E/V133E |
| 26-23 | VH-CH1 | Q39E/S183E | VK-CH1 | Q38E/S183K | VK-CK | Q38K/V133K | VH-CK | Q39K/V133E |
| 26-24 | VH-CH1 | Q39E/S183E | VK-CH1 | Q38K/S183K | VK-CK | Q38K/V133K | VH-CK | Q39E/V133E |
| 26-25 | VH-CH1 | Q39K/S183E | VK-CH1 | Q38E/S183K | VK-CK | Q38E/V133K | VH-CK | Q39K/V133E |
| 26-26 | VH-CH1 | Q39K/S183E | VK-CH1 | Q38K/S183K | VK-CK | Q38E/V133K | VH-CK | Q39E/V133E |
| 26-27 | VH-CH1 | Q39E/S183E | VK-CH1 | Q38E/S183K | VK-CK | Q38K/V133K | VH-CK | Q39K/V133E |
| 26-28 | VH-CH1 | Q39E/S183E | VK-CH1 | Q38K/S183K | VK-CK | Q38K/V133K | VH-CK | Q39E/V133E |
| 26-29 | VH-CH1 | Q39K/S183E | VK-CH1 | Q38E/S183K | VK-CK | Q38E/V133K | VH-CK | Q39K/V133E |
| 26-30 | VH-CH1 | Q39K/S183E | VK-CH1 | Q38K/S183K | VK-CK | Q38E/V133K | VH-CK | Q39E/V133E |
| 26-31 | VH-CH1 | Q39E/S183E | VK-CH1 | Q38E/S183K | VK-CK | Q38K/V133K | VH-CK | Q39K/V133E |
| 26-32 | VH-CH1 | Q39E/S183E | VK-CH1 | Q38K/S183K | VK-CK | Q38K/V133K | VH-CK | Q39E/V133E |
| 26-33 | VH-CH1 | Q39K/S183E | VK-CH1 | Q38E/S183K | VK-CK | Q38E/V133K | VH-CK | Q39K/V133E |
| 26-34 | VH-CH1 | Q39K/S183E | VK-CH1 | Q38K/S183K | VK-CK | Q38E/V133K | VH-CK | Q39E/V133E |
| 26-35 | VH-CH1 | Q39E/S183E | VK-CH1 | Q38E/S183K | VK-CK | Q38K/V133K | VH-CK | Q39K/V133E |
| 26-36 | VH-CH1 | Q39E/S183E | VK-CH1 | Q38K/S183K | VK-CK | Q38K/V133K | VH-CK | Q39E/V133E |
| 26-37 | VH-CH1 | Q39K/S183E | VK-CH1 | Q38E/S183K | VK-CK | Q38E/V133K | VH-CK | Q39K/V133E |
| 26-38 | VH-CH1 | Q39K/S183E | VK-CH1 | Q38K/S183K | VK-CK | Q38E/V133K | VH-CK | Q39E/V133E |
| 26-39 | VH-CH1 | Q39E/S183E | VK-CH1 | Q38E/S183K | VK-CK | Q38K/V133K | VH-CK | Q39K/V133E |
| 26-40 | VH-CH1 | Q39E/S183E | VK-CH1 | Q38K/S183K | VK-CK | Q38K/V133K | VH-CK | Q39E/V133E |
| 26-41 | VH-CH1 | Q39K/S183E | VK-CH1 | Q38E/S183K | VK-CK | Q38E/V133K | VH-CK | Q39K/V133E |
| 26-42 | VH-CH1 | Q39K/S183E | VK-CH1 | Q38K/S183K | VK-CK | Q38E/V133K | VH-CK | Q39E/V133E |
| 26-43 | VH-CH1 | Q39E/S183E | VK-CH1 | Q38E/S183K | VK-CK | Q38K/V133K | VH-CK | Q39K/V133E |
| 26-44 | VH-CH1 | Q39E/S183E | VK-CH1 | Q38K/S183K | VK-CK | Q38K/V133K | VH-CK | Q39E/V133E |
| 26-45 | VH-CH1 | Q39K/S183E | VK-CH1 | Q38E/S183K | VK-CK | Q38E/V133K | VH-CK | Q39K/V133E |
| 26-46 | VH-CH1 | Q39K/S183E | VK-CH1 | Q38K/S183K | VK-CK | Q38E/V133K | VH-CK | Q39E/V133E |
| 26-47 | VH-CH1 | Q39E/S183E | VK-CH1 | Q38E/S183K | VK-CK | Q38K/V133K | VH-CK | Q39K/V133E |
| 26-48 | VH-CH1 | Q39E/S183E | VK-CH1 | Q38K/S183K | VK-CK | Q38K/V133K | VH-CK | Q39E/V133E |
| 26-49 | VH-CH1 | Q39K/S183E | VK-CH1 | Q38E/S183K | VK-CK | Q38E/V133K | VH-CK | Q39K/V133E |
| 26-50 | VH-CH1 | Q39K/S183E | VK-CH1 | Q38K/S183K | VK-CK | Q38E/V133K | VH-CK | Q39E/V133E |
| 26-51 | VH-CH1 | Q39E/S183E | VK-CH1 | Q38E/S183K | VK-CK | Q38K/V133K | VH-CK | Q39K/V133E |
| 26-52 | VH-CH1 | Q39E/S183E | VK-CH1 | Q38K/S183K | VK-CK | Q38K/V133K | VH-CK | Q39E/V133E |
| 26-53 | VH-CH1 | Q39K/S183E | VK-CH1 | Q38E/S183K | VK-CK | Q38E/V133K | VH-CK | Q39K/V133E |
| 26-54 | VH-CH1 | Q39K/S183E | VK-CH1 | Q38K/S183K | VK-CK | Q38E/V133K | VH-CK | Q39E/V133E |
| 26-55 | VH-CH1 | Q39E/S183E | VK-CH1 | Q38E/S183K | VK-CK | Q38K/V133K | VH-CK | Q39K/V133E |
| 26-56 | VH-CH1 | Q39E/S183E | VK-CH1 | Q38K/S183K | VK-CK | Q38K/V133K | VH-CK | Q39E/V133E |

Example 29—Pentavalent/Hexavalent, Trispecific Tetrahedral Antibodies Comprising Two Distinct Fabs that Specifically Bind CD3 and either CD20, ERBB2, or CEACAM5, and the 4-1BB ligand (4-1BBL)

Tetrahedral antibodies incorporating an anti-CD3 domain were designed, expressed, and evaluated for their ability to co-engage T cells and disease target cells, and activate immune cellular signaling via the 4-1BB ligand-receptor interaction, for the treatment of cancer and other disease. This series of bispecific constructs employ VH and VL regions from rituximab (anti-CD20), trastuzumab (anti-ERBB2), or cergutuzumab (anti-CEACAM5) to engage target cells, together with VH and VL regions from SP34 (anti-CD3) to engage T cells, and the 4-1BB ligand to activate T cells (Tables 75, 76). Two tetrahedral antibody configurations were employed (Table 77). In the first configuration, the disease targeting Fab domain (anti-CD20, anti-ERBB2, or anti-CEACAM5) is placed in D3/D4 (bivalent), the T cell engaging Fab domain is placed in D6 (monovalent) and/or D5/D6 (bivalent), D1/D2 are Fc domains, and the 4-1BB ligand is placed in D7/D8. In the second configuration, the disease targeting Fab domain (anti-CD19 or anti-CD20) is placed in D3/D4 (bivalent), the T cell engaging Fab domain is placed in D2 (monovalent), D1 is an Fc domain, and the 4-1BB ligand is placed in D7/D8. To achieve placement of the 4-1BB ligand, it is variously attached at the C-terminus of the H1, H2, Fc, or Fab chains (Table 77). To optimize correct VH/VL pairing and to minimize VH/VL mispairing, V region exchange is combined with four different sets of charge pairs to ensure correct pairing of heavy and light chain V regions (Table 78). Additionally, to further facilitate purification of the correctly paired product by Protein A chromatography, for bivalent CD3, the H1 chain incorporates the H435R/Y436F substitution (for bivalent CD3); for monovalent CD3, both the H1 and H2 chains incorporate the H435R/Y436F substitution. The constructs are then evaluated for their structural bispecificity by intact mass spectrometry as described in Example 18, and for their functional bispecificity using a variety of in vitro binding assays, cytotoxicity assays, and cytokine induction and release assays, and in vivo cancer efficacy models, known to one skilled in the art.

TABLE 75

| Protein ID | H1 Chain | H2 Chain | L1 Chain | L2 Chain | Fc Chain |
|---|---|---|---|---|---|
| 27-01 | SEQ ID NO: 5035 | SEQ ID NO: 5036 | SEQ ID NO: 5061 | SEQ ID NO: 5062 | SEQ ID NO: 5068 |
| 27-02 | SEQ ID NO: 5035 | SEQ ID NO: 5037 | SEQ ID NO: 5061 | SEQ ID NO: 5063 | SEQ ID NO: 5068 |
| 27-03 | SEQ ID NO: 5038 | SEQ ID NO: 5039 | SEQ ID NO: 5061 | SEQ ID NO: 5062 | SEQ ID NO: 5068 |
| 27-04 | SEQ ID NO: 5038 | SEQ ID NO: 5040 | SEQ ID NO: 5061 | SEQ ID NO: 5063 | SEQ ID NO: 5068 |
| 27-05 | SEQ ID NO: 5038 | SEQ ID NO: 5036 | SEQ ID NO: 5061 | SEQ ID NO: 5062 | SEQ ID NO: 5069 |
| 27-06 | SEQ ID NO: 5038 | SEQ ID NO: 5037 | SEQ ID NO: 5061 | SEQ ID NO: 5063 | |
| 27-07 | SEQ ID NO: 5035 | SEQ ID NO: 5041 | SEQ ID NO: 5061 | SEQ ID NO: 5062 | |
| 27-08 | SEQ ID NO: 5035 | SEQ ID NO: 5042 | SEQ ID NO: 5061 | SEQ ID NO: 5063 | |
| 27-09 | SEQ ID NO: 5038 | SEQ ID NO: 5043 | SEQ ID NO: 5061 | SEQ ID NO: 5062 | |
| 27-10 | SEQ ID NO: 5038 | SEQ ID NO: 5044 | SEQ ID NO: 5061 | SEQ ID NO: 5063 | SEQ ID NO: 5068 |
| 27-11 | SEQ ID NO: 5038 | SEQ ID NO: 5041 | SEQ ID NO: 5061 | SEQ ID NO: 5062 | SEQ ID NO: 5068 |
| 27-12 | SEQ ID NO: 5038 | SEQ ID NO: 5042 | SEQ ID NO: 5061 | SEQ ID NO: 5063 | SEQ ID NO: 5068 |
| 27-13 | SEQ ID NO: 5038 | SEQ ID NO: 5041 | SEQ ID NO: 5061 | SEQ ID NO: 5064 | SEQ ID NO: 5068 |
| 27-14 | SEQ ID NO: 5038 | SEQ ID NO: 5042 | SEQ ID NO: 5061 | SEQ ID NO: 5065 | SEQ ID NO: 5069 |
| 27-15 | SEQ ID NO: 5035 | SEQ ID NO: 5045 | SEQ ID NO: 5061 | SEQ ID NO: 5062 | SEQ ID NO: 5069 |
| 27-16 | SEQ ID NO: 5035 | SEQ ID NO: 5046 | SEQ ID NO: 5061 | SEQ ID NO: 5063 | SEQ ID NO: 5068 |
| 27-17 | SEQ ID NO: 5038 | SEQ ID NO: 5047 | SEQ ID NO: 5061 | SEQ ID NO: 5062 | SEQ ID NO: 5068 |
| 27-18 | SEQ ID NO: 5038 | SEQ ID NO: 5048 | SEQ ID NO: 5061 | SEQ ID NO: 5063 | |
| 27-19 | SEQ ID NO: 5049 | SEQ ID NO: 5036 | SEQ ID NO: 5066 | SEQ ID NO: 5062 | |
| 27-20 | SEQ ID NO: 5049 | SEQ ID NO: 5037 | SEQ ID NO: 5066 | SEQ ID NO: 5063 | |
| 27-21 | SEQ ID NO: 5050 | SEQ ID NO: 5039 | SEQ ID NO: 5066 | SEQ ID NO: 5062 | |
| 27-22 | SEQ ID NO: 5050 | SEQ ID NO: 5040 | SEQ ID NO: 5066 | SEQ ID NO: 5063 | SEQ ID NO: 5068 |
| 27-23 | SEQ ID NO: 5050 | SEQ ID NO: 5036 | SEQ ID NO: 5066 | SEQ ID NO: 5062 | SEQ ID NO: 5068 |
| 27-24 | SEQ ID NO: 5050 | SEQ ID NO: 5037 | SEQ ID NO: 5066 | SEQ ID NO: 5063 | SEQ ID NO: 5068 |
| 27-25 | SEQ ID NO: 5049 | SEQ ID NO: 5051 | SEQ ID NO: 5066 | SEQ ID NO: 5062 | SEQ ID NO: 5068 |
| 27-26 | SEQ ID NO: 5049 | SEQ ID NO: 5052 | SEQ ID NO: 5066 | SEQ ID NO: 5063 | SEQ ID NO: 5069 |
| 27-27 | SEQ ID NO: 5050 | SEQ ID NO: 5053 | SEQ ID NO: 5066 | SEQ ID NO: 5062 | SEQ ID NO: 5069 |
| 27-28 | SEQ ID NO: 5050 | SEQ ID NO: 5054 | SEQ ID NO: 5066 | SEQ ID NO: 5063 | SEQ ID NO: 5068 |
| 27-29 | SEQ ID NO: 5050 | SEQ ID NO: 5051 | SEQ ID NO: 5066 | SEQ ID NO: 5062 | SEQ ID NO: 5068 |
| 27-30 | SEQ ID NO: 5050 | SEQ ID NO: 5052 | SEQ ID NO: 5066 | SEQ ID NO: 5063 | SEQ ID NO: 5068 |
| 27-31 | SEQ ID NO: 5050 | SEQ ID NO: 5051 | SEQ ID NO: 5066 | SEQ ID NO: 5064 | SEQ ID NO: 5068 |
| 27-32 | SEQ ID NO: 5050 | SEQ ID NO: 5052 | SEQ ID NO: 5066 | SEQ ID NO: 5065 | SEQ ID NO: 5069 |
| 27-33 | SEQ ID NO: 5049 | SEQ ID NO: 5045 | SEQ ID NO: 5066 | SEQ ID NO: 5062 | SEQ ID NO: 5069 |
| 27-34 | SEQ ID NO: 5049 | SEQ ID NO: 5046 | SEQ ID NO: 5066 | SEQ ID NO: 5063 | SEQ ID NO: 5068 |
| 27-35 | SEQ ID NO: 5050 | SEQ ID NO: 5047 | SEQ ID NO: 5066 | SEQ ID NO: 5062 | SEQ ID NO: 5068 |
| 27-36 | SEQ ID NO: 5050 | SEQ ID NO: 5048 | SEQ ID NO: 5066 | SEQ ID NO: 5063 | |
| 27-37 | SEQ ID NO: 5055 | SEQ ID NO: 5036 | SEQ ID NO: 5067 | SEQ ID NO: 5062 | |
| 27-38 | SEQ ID NO: 5055 | SEQ ID NO: 5037 | SEQ ID NO: 5067 | SEQ ID NO: 5063 | |
| 27-39 | SEQ ID NO: 5056 | SEQ ID NO: 5039 | SEQ ID NO: 5067 | SEQ ID NO: 5062 | |
| 27-40 | SEQ ID NO: 5056 | SEQ ID NO: 5040 | SEQ ID NO: 5067 | SEQ ID NO: 5063 | SEQ ID NO: 5068 |
| 27-41 | SEQ ID NO: 5056 | SEQ ID NO: 5036 | SEQ ID NO: 5067 | SEQ ID NO: 5062 | SEQ ID NO: 5068 |
| 27-42 | SEQ ID NO: 5056 | SEQ ID NO: 5037 | SEQ ID NO: 5067 | SEQ ID NO: 5063 | SEQ ID NO: 5068 |
| 27-43 | SEQ ID NO: 5055 | SEQ ID NO: 5057 | SEQ ID NO: 5067 | SEQ ID NO: 5062 | SEQ ID NO: 5068 |
| 27-44 | SEQ ID NO: 5055 | SEQ ID NO: 5058 | SEQ ID NO: 5067 | SEQ ID NO: 5063 | SEQ ID NO: 5069 |
| 27-45 | SEQ ID NO: 5056 | SEQ ID NO: 5059 | SEQ ID NO: 5067 | SEQ ID NO: 5062 | SEQ ID NO: 5069 |
| 27-46 | SEQ ID NO: 5056 | SEQ ID NO: 5060 | SEQ ID NO: 5067 | SEQ ID NO: 5063 | SEQ ID NO: 5068 |
| 27-47 | SEQ ID NO: 5056 | SEQ ID NO: 5057 | SEQ ID NO: 5067 | SEQ ID NO: 5062 | SEQ ID NO: 5068 |
| 27-48 | SEQ ID NO: 5056 | SEQ ID NO: 5058 | SEQ ID NO: 5067 | SEQ ID NO: 5063 | SEQ ID NO: 5068 |
| 27-49 | SEQ ID NO: 5056 | SEQ ID NO: 5057 | SEQ ID NO: 5067 | SEQ ID NO: 5064 | SEQ ID NO: 5068 |

TABLE 75-continued

| Protein ID | H1 Chain | H2 Chain | L1 Chain | L2 Chain | Fc Chain |
|---|---|---|---|---|---|
| 27-50 | SEQ ID NO: 5056 | SEQ ID NO: 5058 | SEQ ID NO: 5067 | SEQ ID NO: 5065 | SEQ ID NO: 5069 |
| 27-51 | SEQ ID NO: 5055 | SEQ ID NO: 5045 | SEQ ID NO: 5067 | SEQ ID NO: 5062 | SEQ ID NO: 5069 |
| 27-52 | SEQ ID NO: 5055 | SEQ ID NO: 5046 | SEQ ID NO: 5067 | SEQ ID NO: 5063 | SEQ ID NO: 5068 |
| 27-53 | SEQ ID NO: 5056 | SEQ ID NO: 5047 | SEQ ID NO: 5067 | SEQ ID NO: 5062 | SEQ ID NO: 5068 |
| 27-54 | SEQ ID NO: 5056 | SEQ ID NO: 5048 | SEQ ID NO: 5067 | SEQ ID NO: 5063 | |

TABLE 76

| Protein ID | D1-Fc | D7 (4-1BBL) | D5-Fab | D4-Fab | D3-Fab | D6-Fab | D2-Fab | D8 (4-1BBL) | D2-Fc |
|---|---|---|---|---|---|---|---|---|---|
| 27-01 | L234A/L235A/P329G | H1 chain | | Rituximab | Rituximab | SP34 | | H1 chain | L234A/L235A/P329G |
| 27-02 | L234A/L235A/P329G | H1 chain | | Rituximab | Rituximab | SP34 | | H1 chain | L234A/L235A/P329G |
| 27-03 | L234A/L235A/P329G | H2 chain | | Rituximab | Rituximab | SP34 | | H2 chain | L234A/L235A/P329G |
| 27-04 | L234A/L235A/P329G | H2 chain | | Rituximab | Rituximab | SP34 | | H2 chain | L234A/L235A/P329G |
| 27-05 | L234A/L235A/P329G | Fc chain | | Rituximab | Rituximab | SP34 | | Fc chain | L234A/L235A/P329G |
| 27-06 | L234A/L235A/P329G | Fc chain | | Rituximab | Rituximab | SP34 | | Fc chain | L234A/L235A/P329G |
| 27-07 | L234A/L235A/P329G | H1 chain | | Rituximab | Rituximab | | SP34 | H1 chain | |
| 27-08 | L234A/L235A/P329G | H1 chain | | Rituximab | Rituximab | | SP34 | H1 chain | |
| 27-09 | L234A/L235A/P329G | H2 chain | | Rituximab | Rituximab | | SP34 | H2 chain | |
| 27-10 | L234A/L235A/P329G | H2 chain | | Rituximab | Rituximab | | SP34 | H2 chain | |
| 27-11 | L234A/L235A/P329G | Fc chain | | Rituximab | Rituximab | | SP34 | Fc chain | |
| 27-12 | L234A/L235A/P329G | Fc chain | | Rituximab | Rituximab | | SP34 | Fc chain | |
| 27-13 | L234A/L235A/P329G | Fab chain | | Rituximab | Rituximab | | SP34 | Fab chain | |
| 27-14 | L234A/L235A/P329G | Fab chain | | Rituximab | Rituximab | | SP34 | Fab chain | |
| 27-15 | L234A/L235A/P329G | H1 chain | SP34 | Rituximab | Rituximab | SP34 | | H1 chain | L234A/L235A/P329G |
| 27-16 | L234A/L235A/P329G | H1 chain | SP34 | Rituximab | Rituximab | SP34 | | H1 chain | L234A/L235A/P329G |
| 27-17 | L234A/L235A/P329G | H2 chain | SP34 | Rituximab | Rituximab | SP34 | | H2 chain | L234A/L235A/P329G |
| 27-18 | L234A/L235A/P329G | H2 chain | SP34 | Rituximab | Rituximab | SP34 | | H2 chain | L234A/L235A/P329G |
| 27-19 | L234A/L235A/P329G | H1 chain | | Trastuzumab | Trastuzumab | SP34 | | H1 chain | L234A/L235A/P329G |
| 27-20 | L234A/L235A/P329G | H1 chain | | Trastuzumab | Trastuzumab | SP34 | | H1 chain | L234A/L235A/P329G |
| 27-21 | L234A/L235A/P329G | H2 chain | | Trastuzumab | Trastuzumab | SP34 | | H2 chain | L234A/L235A/P329G |
| 27-22 | L234A/L235A/P329G | H2 chain | | Trastuzumab | Trastuzumab | SP34 | | H2 chain | L234A/L235A/P329G |
| 27-23 | L234A/L235A/P329G | Fc chain | | Trastuzumab | Trastuzumab | SP34 | | Fc chain | L234A/L235A/P329G |
| 27-24 | L234A/L235A/P329G | Fc chain | | Trastuzumab | Trastuzumab | SP34 | | Fc chain | L234A/L235A/P329G |
| 27-25 | L234A/L235A/P329G | H1 chain | | Trastuzumab | Trastuzumab | | SP34 | H1 chain | |
| 27-26 | L234A/L235A/P329G | H1 chain | | Trastuzumab | Trastuzumab | | SP34 | H1 chain | |
| 27-27 | L234A/L235A/P329G | H2 chain | | Trastuzumab | Trastuzumab | | SP34 | H2 chain | |
| 27-28 | L234A/L235A/P329G | H2 chain | | Trastuzumab | Trastuzumab | | SP34 | H2 chain | |
| 27-29 | L234A/L235A/P329G | Fc chain | | Trastuzumab | Trastuzumab | | SP34 | Fc chain | |
| 27-30 | L234A/L235A/P329G | Fc chain | | Trastuzumab | Trastuzumab | | SP34 | Fc chain | |
| 27-31 | L234A/L235A/P329G | Fab chain | | Trastuzumab | Trastuzumab | | SP34 | Fab chain | |
| 27-32 | L234A/L235A/P329G | Fab chain | | Trastuzumab | Trastuzumab | | SP34 | Fab chain | |
| 27-33 | L234A/L235A/P329G | H1 chain | SP34 | Trastuzumab | Trastuzumab | SP34 | | H1 chain | L234A/L235A/P329G |
| 27-34 | L234A/L235A/P329G | H1 chain | SP34 | Trastuzumab | Trastuzumab | SP34 | | H1 chain | L234A/L235A/P329G |
| 27-35 | L234A/L235A/P329G | H2 chain | SP34 | Trastuzumab | Trastuzumab | SP34 | | H2 chain | L234A/L235A/P329G |
| 27-36 | L234A/L235A/P329G | H2 chain | SP34 | Trastuzumab | Trastuzumab | SP34 | | H2 chain | L234A/L235A/P329G |
| 27-37 | L234A/L235A/P329G | H1 chain | | Cergutuzumab | Cergutuzumab | SP34 | | H1 chain | L234A/L235A/P329G |
| 27-38 | L234A/L235A/P329G | H1 chain | | Cergutuzumab | Cergutuzumab | SP34 | | H1 chain | L234A/L235A/P329G |
| 27-39 | L234A/L235A/P329G | H2 chain | | Cergutuzumab | Cergutuzumab | SP34 | | H2 chain | L234A/L235A/P329G |
| 27-40 | L234A/L235A/P329G | H2 chain | | Cergutuzumab | Cergutuzumab | SP34 | | H2 chain | L234A/L235A/P329G |
| 27-41 | L234A/L235A/P329G | Fc chain | | Cergutuzumab | Cergutuzumab | SP34 | | Fc chain | L234A/L235A/P329G |
| 27-42 | L234A/L235A/P329G | Fc chain | | Cergutuzumab | Cergutuzumab | SP34 | | Fc chain | L234A/L235A/P329G |
| 27-43 | L234A/L235A/P329G | H1 chain | | Cergutuzumab | Cergutuzumab | | SP34 | H1 chain | |
| 27-44 | L234A/L235A/P329G | H1 chain | | Cergutuzumab | Cergutuzumab | | SP34 | H1 chain | |
| 27-45 | L234A/L235A/P329G | H2 chain | | Cergutuzumab | Cergutuzumab | | SP34 | H2 chain | |
| 27-46 | L234A/L235A/P329G | H2 chain | | Cergutuzumab | Cergutuzumab | | SP34 | H2 chain | |
| 27-47 | L234A/L235A/P329G | Fc chain | | Cergutuzumab | Cergutuzumab | | SP34 | Fc chain | |
| 27-48 | L234A/L235A/P329G | Fc chain | | Cergutuzumab | Cergutuzumab | | SP34 | Fc chain | |
| 27-49 | L234A/L235A/P329G | Fab chain | | Cergutuzumab | Cergutuzumab | | SP34 | Fab chain | |
| 27-50 | L234A/L235A/P329G | Fab chain | | Cergutuzumab | Cergutuzumab | | SP34 | Fab chain | |
| 27-51 | L234A/L235A/P329G | H1 chain | SP34 | Cergutuzumab | Cergutuzumab | SP34 | | H1 chain | L234A/L235A/P329G |
| 27-52 | L234A/L235A/P329G | H1 chain | SP34 | Cergutuzumab | Cergutuzumab | SP34 | | H1 chain | L234A/L235A/P329G |
| 27-53 | L234A/L235A/P329G | H2 chain | SP34 | Cergutuzumab | Cergutuzumab | SP34 | | H2 chain | L234A/L235A/P329G |
| 27-54 | L234A/L235A/P329G | H2 chain | SP34 | Cergutuzumab | Cergutuzumab | SP34 | | H2 chain | L234A/L235A/P329G |

TABLE 77

| Protein ID | D1-Fc Specificity | D7 Specificity | D5-Fab Specificity | D4-Fab Specificity | D3-Fab Specificity | D6-Fab Specificity | D2-Fab Specificity | D8 Specificity | D2-Fc Specificity |
|---|---|---|---|---|---|---|---|---|---|
| 27-01 | FcgR silent | 4-1BB | | CD20 | CD20 | CD3 | | 4-1BB | FcgR silent |
| 27-02 | FcgR silent | 4-1BB | | CD20 | CD20 | CD3 | | 4-1BB | FcgR silent |
| 27-03 | FcgR silent | 4-1BB | | CD20 | CD20 | CD3 | | 4-1BB | FcgR silent |
| 27-04 | FcgR silent | 4-1BB | | CD20 | CD20 | CD3 | | 4-1BB | FcgR silent |
| 27-05 | FcgR silent | 4-1BB | | CD20 | CD20 | CD3 | | 4-1BB | FcgR silent |
| 27-06 | FcgR silent | 4-1BB | | CD20 | CD20 | CD3 | | 4-1BB | FcgR silent |
| 27-07 | FcgR silent | 4-1BB | | CD20 | CD20 | | CD3 | 4-1BB | FcgR silent |
| 27-08 | FcgR silent | 4-1BB | | CD20 | CD20 | | CD3 | 4-1BB | FcgR silent |
| 27-09 | FcgR silent | 4-1BB | | CD20 | CD20 | | CD3 | 4-1BB | FcgR silent |
| 27-10 | FcgR silent | 4-1BB | | CD20 | CD20 | | CD3 | 4-1BB | FcgR silent |
| 27-11 | FcgR silent | 4-1BB | | CD20 | CD20 | | CD3 | 4-1BB | FcgR silent |
| 27-12 | FcgR silent | 4-1BB | | CD20 | CD20 | | CD3 | 4-1BB | FcgR silent |
| 27-13 | FcgR silent | 4-1BB | | CD20 | CD20 | | CD3 | 4-1BB | FcgR silent |
| 27-14 | FcgR silent | 4-1BB | | CD20 | CD20 | | CD3 | 4-1BB | FcgR silent |
| 27-15 | FcgR silent | 4-1BB | CD3 | CD20 | CD20 | CD3 | | 4-1BB | FcgR silent |
| 27-16 | FcgR silent | 4-1BB | CD3 | CD20 | CD20 | CD3 | | 4-1BB | FcgR silent |
| 27-17 | FcgR silent | 4-1BB | CD3 | CD20 | CD20 | CD3 | | 4-1BB | FcgR silent |
| 27-18 | FcgR silent | 4-1BB | CD3 | CD20 | CD20 | CD3 | | 4-1BB | FcgR silent |
| 27-19 | FcgR silent | 4-1BB | | ERBB2 | ERBB2 | CD3 | | 4-1BB | FcgR silent |
| 27-20 | FcgR silent | 4-1BB | | ERBB2 | ERBB2 | CD3 | | 4-1BB | FcgR silent |
| 27-21 | FcgR silent | 4-1BB | | ERBB2 | ERBB2 | CD3 | | 4-1BB | FcgR silent |
| 27-22 | FcgR silent | 4-1BB | | ERBB2 | ERBB2 | CD3 | | 4-1BB | FcgR silent |
| 27-23 | FcgR silent | 4-1BB | | ERBB2 | ERBB2 | CD3 | | 4-1BB | FcgR silent |
| 27-24 | FcgR silent | 4-1BB | | ERBB2 | ERBB2 | CD3 | | 4-1BB | FcgR silent |
| 27-25 | FcgR silent | 4-1BB | | ERBB2 | ERBB2 | | CD3 | 4-1BB | FcgR silent |
| 27-26 | FcgR silent | 4-1BB | | ERBB2 | ERBB2 | | CD3 | 4-1BB | FcgR silent |
| 27-27 | FcgR silent | 4-1BB | | ERBB2 | ERBB2 | | CD3 | 4-1BB | FcgR silent |
| 27-28 | FcgR silent | 4-1BB | | ERBB2 | ERBB2 | | CD3 | 4-1BB | FcgR silent |
| 27-29 | FcgR silent | 4-1BB | | ERBB2 | ERBB2 | | CD3 | 4-1BB | FcgR silent |
| 27-30 | FcgR silent | 4-1BB | | ERBB2 | ERBB2 | | CD3 | 4-1BB | FcgR silent |
| 27-31 | FcgR silent | 4-1BB | | ERBB2 | ERBB2 | | CD3 | 4-1BB | FcgR silent |
| 27-32 | FcgR silent | 4-1BB | | ERBB2 | ERBB2 | | CD3 | 4-1BB | FcgR silent |
| 27-33 | FcgR silent | 4-1BB | CD3 | ERBB2 | ERBB2 | CD3 | | 4-1BB | FcgR silent |
| 27-34 | FcgR silent | 4-1BB | CD3 | ERBB2 | ERBB2 | CD3 | | 4-1BB | FcgR silent |
| 27-35 | FcgR silent | 4-1BB | CD3 | ERBB2 | ERBB2 | CD3 | | 4-1BB | FcgR silent |
| 27-36 | FcgR silent | 4-1BB | CD3 | ERBB2 | ERBB2 | CD3 | | 4-1BB | FcgR silent |
| 27-37 | FcgR silent | 4-1BB | | CEACAM5 | CEACAM5 | CD3 | | 4-1BB | FcgR silent |
| 27-38 | FcgR silent | 4-1BB | | CEACAM5 | CEACAM5 | CD3 | | 4-1BB | FcgR silent |
| 27-39 | FcgR silent | 4-1BB | | CEACAM5 | CEACAM5 | CD3 | | 4-1BB | FcgR silent |
| 27-40 | FcgR silent | 4-1BB | | CEACAM5 | CEACAM5 | CD3 | | 4-1BB | FcgR silent |
| 27-41 | FcgR silent | 4-1BB | | CEACAM5 | CEACAM5 | CD3 | | 4-1BB | FcgR silent |
| 27-42 | FcgR silent | 4-1BB | | CEACAM5 | CEACAM5 | CD3 | | 4-1BB | FcgR silent |
| 27-43 | FcgR silent | 4-1BB | | CEACAM5 | CEACAM5 | | CD3 | 4-1BB | FcgR silent |
| 27-44 | FcgR silent | 4-1BB | | CEACAM5 | CEACAM5 | | CD3 | 4-1BB | FcgR silent |
| 27-45 | FcgR silent | 4-1BB | | CEACAM5 | CEACAM5 | | CD3 | 4-1BB | FcgR silent |
| 27-46 | FcgR silent | 4-1BB | | CEACAM5 | CEACAM5 | | CD3 | 4-1BB | FcgR silent |
| 27-47 | FcgR silent | 4-1BB | | CEACAM5 | CEACAM5 | | CD3 | 4-1BB | FcgR silent |
| 27-48 | FcgR silent | 4-1BB | | CEACAM5 | CEACAM5 | | CD3 | 4-1BB | FcgR silent |
| 27-49 | FcgR silent | 4-1BB | | CEACAM5 | CEACAM5 | | CD3 | 4-1BB | FcgR silent |
| 27-50 | FcgR silent | 4-1BB | | CEACAM5 | CEACAM5 | | CD3 | 4-1BB | FcgR silent |
| 27-51 | FcgR silent | 4-1BB | CD3 | CEACAM5 | CEACAM5 | CD3 | | 4-1BB | FcgR silent |
| 27-52 | FcgR silent | 4-1BB | CD3 | CEACAM5 | CEACAM5 | CD3 | | 4-1BB | FcgR silent |
| 27-53 | FcgR silent | 4-1BB | CD3 | CEACAM5 | CEACAM5 | CD3 | | 4-1BB | FcgR silent |
| 27-54 | FcgR silent | 4-1BB | CD3 | CEACAM5 | CEACAM5 | CD3 | | 4-1BB | FcgR silent |

TABLE 78

| | H1 Chain | | H2 Chain | | L1 Chain | | L2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 27-01 | VH-CH1 | Q39K/S183E | VK-CH1 | Q38E/S183K | VK-CK | Q38E/V133K | VH-CK | Q39K/V133E |
| 27-02 | VH-CH1 | Q39K/S183E | VK-CH1 | Q38K/S183K | VK-CK | Q38E/V133K | VH-CK | Q39E/V133E |
| 27-03 | VH-CH1 | Q39K/S183E | VK-CH1 | Q38E/S183K | VK-CK | Q38E/V133K | VH-CK | Q39K/V133E |
| 27-04 | VH-CH1 | Q39K/S183E | VK-CH1 | Q38K/S183K | VK-CK | Q38E/V133K | VH-CK | Q39E/V133E |
| 27-05 | VH-CH1 | Q39K/S183E | VK-CH1 | Q38E/S183K | VK-CK | Q38E/V133K | VH-CK | Q39K/V133E |
| 27-06 | VH-CH1 | Q39K/S183E | VK-CH1 | Q38K/S183K | VK-CK | Q38E/V133K | VH-CK | Q39E/V133E |
| 27-07 | VH-CH1 | Q39K/S183E | VH-CH1<br>VK-CH1 | Q39K/S183E<br>Q38E/S183K | VK-CK | Q38E/V133K | VH-CK | Q39K/V133E |
| 27-08 | VH-CH1 | Q39K/S183E | VH-CH1<br>VK-CH1 | Q39K/S183E<br>Q38K/S183K | VK-CK | Q38E/V133K | VH-CK | Q39E/V133E |
| 27-09 | VH-CH1 | Q39K/S183E | VH-CH1<br>VK-CH1 | Q39K/S183E<br>Q38E/S183K | VK-CK | Q38E/V133K | VH-CK | Q39K/V133E |

TABLE 78-continued

| | H1 Chain | | H2 Chain | | L1 Chain | | L2 Chain | |
|---|---|---|---|---|---|---|---|---|
| Protein ID | V region type | Amino acid Substitutions | V region Type | Amino acid Substitutions | V region Type | Amino acid Substitutions | V region Type | Amino acid Substitutions |
| 27-10 | VH-CH1 | Q39K/S183E | VH-CH1I<br>VK-CH1 | Q39K/S183E<br>Q38K/S183K | VK-CK | Q38E/V133K | VH-CK | Q39E/V133E |
| 27-11 | VH-CH1 | Q39K/S183E | VH-CH1<br>VK-CH1 | Q39K/S183E<br>Q38E/S183K | VK-CK | Q38E/V133K | VH-CK | Q39K/V133E |
| 27-12 | VH-CH1 | Q39K/S183E | VH-CH1<br>VK-CH1 | Q39K/S183E<br>Q38K/S183K | VK-CK | Q38E/V133K | VH-CK | Q39E/V133E |
| 27-13 | VH-CH1 | Q39K/S183E | VH-CH1<br>VK-CH1 | Q39K/S183E<br>Q38E/S183K | VK-CK | Q38E/V133K | VH-CK | Q39K/V133E |
| 27-14 | VH-CH1 | Q39K/S183E | VH-CH1<br>VK-CH1 | Q39K/S183E<br>Q38K/S183K | VK-CK | Q38E/V133K | VH-CK | Q39E/V133E |
| 27-15 | VH-CH1 | Q39K/S183E | VK-CH1 | Q38E/S183K | VK-CK | Q38E/V133K | VH-CK | Q39K/V133E |
| 27-16 | VH-CH1 | Q39K/S183E | VK-CH1 | Q38K/S183K | VK-CK | Q38E/V133K | VH-CK | Q39E/V133E |
| 27-17 | VH-CH1 | Q39K/S183E | VK-CH1 | Q38E/S183K | VK-CK | Q38E/V133K | VH-CK | Q39K/V133E |
| 27-18 | VH-CH1 | Q39K/S183E | VK-CH1 | Q38K/S183K | VK-CK | Q38E/V133K | VH-CK | Q39E/V133E |
| 27-19 | VH-CH1 | Q39K/S183E | VK-CH1 | Q38E/S183K | VK-CK | Q38E/V133K | VH-CK | Q39K/V133E |
| 27-20 | VH-CH1 | Q39K/S183E | VK-CH1 | Q38K/S183K | VK-CK | Q38E/V133K | VH-CK | Q39E/V133E |
| 27-21 | VH-CH1 | Q39K/S183E | VK-CH1 | Q38E/S183K | VK-CK | Q38E/V133K | VH-CK | Q39K/V133E |
| 27-22 | VH-CH1 | Q39K/S183E | VK-CH1 | Q38K/S183K | VK-CK | Q38E/V133K | VH-CK | Q39E/V133E |
| 27-23 | VH-CH1 | Q39K/S183E | VK-CH1 | Q38E/S183K | VK-CK | Q38E/V133K | VH-CK | Q39K/V133E |
| 27-24 | VH-CH1 | Q39K/S183E | VK-CH1 | Q38K/S183K | VK-CK | Q38E/V133K | VH-CK | Q39E/V133E |
| 27-25 | VH-CH1 | Q39K/S183E | VH-CH1<br>VK-CH1 | Q39K/S183E<br>Q38E/S183K | VK-CK | Q38E/V133K | VH-CK | Q39K/V133E |
| 27-26 | VH-CH1 | Q39K/S183E | VH-CH1<br>VK-CH1 | Q39K/S183E<br>Q38K/S183K | VK-CK | Q38E/V133K | VH-CK | Q39E/V133E |
| 27-27 | VH-CH1 | Q39K/S183E | VH-CH1<br>VK-CH1 | Q39K/S183E<br>Q38E/S183K | VK-CK | Q38E/V133K | VH-CK | Q39K/V133E |
| 27-28 | VH-CH1 | Q39K/S183E | VH-CH1<br>VK-CH1 | Q39K/S183E<br>Q38K/S183K | VK-CK | Q38E/V133K | VH-CK | Q39E/V133E |
| 27-29 | VH-CH1 | Q39K/S183E | VH-CH1<br>VK-CH1 | Q39K/S183E<br>Q38E/S183K | VK-CK | Q38E/V133K | VH-CK | Q39K/V133E |
| 27-30 | VH-CH1 | Q39K/S183E | VH-CH1<br>VK-CH1 | Q39K/S183E<br>Q38K/S183K | VK-CK | Q38E/V133K | VH-CK | Q39E/V133E |
| 27-31 | VH-CH1 | Q39K/S183E | VH-CH1<br>VK-CH1 | Q39K/S183E<br>Q38E/S183K | VK-CK | Q38E/V133K | VH-CK | Q39K/V133E |
| 27-32 | VH-CH1 | Q39K/S183E | VH-CH1<br>VK-CH1 | Q39K/S183E<br>Q38K/S183K | VK-CK | Q38E/V133K | VH-CK | Q39E/V133E |
| 27-33 | VH-CH1 | Q39K/S183E | VK-CH1 | Q38E/S183K | VK-CK | Q38E/V133K | VH-CK | Q39K/V133E |
| 27-34 | VH-CH1 | Q39K/S183E | VK-CH1 | Q38K/S183K | VK-CK | Q38E/V133K | VH-CK | Q39E/V133E |
| 27-35 | VH-CH1 | Q39K/S183E | VK-CH1 | Q38E/S183K | VK-CK | Q38E/V133K | VH-CK | Q39K/V133E |
| 27-36 | VH-CH1 | Q39K/S183E | VK-CH1 | Q38K/S183K | VK-CK | Q38E/V133K | VH-CK | Q39E/V133E |
| 27-37 | VH-CH1 | Q39K/S183E | VK-CH1 | Q38E/S183K | VK-CK | Q38E/V133K | VH-CK | Q39K/V133E |
| 27-38 | VH-CH1 | Q39K/S183E | VK-CH1 | Q38K/S183K | VK-CK | Q38E/V133K | VH-CK | Q39E/V133E |
| 27-39 | VH-CH1 | Q39K/S183E | VK-CH1 | Q38E/S183K | VK-CK | Q38E/V133K | VH-CK | Q39K/V133E |
| 27-40 | VH-CH1 | Q39K/S183E | VK-CH1 | Q38K/S183K | VK-CK | Q38E/V133K | VH-CK | Q39E/V133E |
| 27-41 | VH-CH1 | Q39K/S183E | VK-CH1 | Q38E/S183K | VK-CK | Q38E/V133K | VH-CK | Q39K/V133E |
| 27-42 | VH-CH1 | Q39K/S183E | VK-CH1 | Q38K/S183K | VK-CK | Q38E/V133K | VH-CK | Q39E/V133E |
| 27-43 | VH-CH1 | Q39K/S183E | VH-CH1<br>VK-CH1 | Q39K/S183E<br>Q38E/S183K | VK-CK | Q38E/V133K | VH-CK | Q39K/V133E |
| 27-44 | VH-CH1 | Q39K/S183E | VH-CH1<br>VK-CH1 | Q39K/S183E<br>Q38K/S183K | VK-CK | Q38E/V133K | VH-CK | Q39E/V133E |
| 27-45 | VH-CH1 | Q39K/S183E | VH-CH1<br>VK-CH1 | Q39K/S183E<br>Q38E/S183K | VK-CK | Q38E/V133K | VH-CK | Q39K/V133E |
| 27-46 | VH-CH1 | Q39K/S183E | VH-CH1<br>VK-CH1 | Q39K/S183E<br>Q38K/S183K | VK-CK | Q38E/V133K | VH-CK | Q39E/V133E |
| 27-47 | VH-CH1 | Q39K/S183E | VH-CH1<br>VK-CH1 | Q39K/S183E<br>Q38E/S183K | VK-CK | Q38E/V133K | VH-CK | Q39K/V133E |
| 27-48 | VH-CH1 | Q39K/S183E | VH-CH1<br>VK-CH1 | Q39K/S183E<br>Q38K/S183K | VK-CK | Q38E/V133K | VH-CK | Q39E/V133E |
| 27-49 | VH-CH1 | Q39K/S183E | VH-CH1<br>VK-CH1 | Q39K/S183E<br>Q38E/S183K | VK-CK | Q38E/V133K | VH-CK | Q39K/V133E |
| 27-50 | VH-CH1 | Q39K/S183E | VH-CH1<br>VK-CH1 | Q39K/S183E<br>Q38K/S183K | VK-CK | Q38E/V133K | VH-CK | Q39E/V133E |
| 27-51 | VH-CH1 | Q39K/S183E | VK-CH1 | Q38E/S183K | VK-CK | Q38E/V133K | VH-CK | Q39K/V133E |
| 27-52 | VH-CH1 | Q39K/S183E | VK-CH1 | Q38K/S183K | VK-CK | Q38E/V133K | VH-CK | Q39E/V133E |
| 27-53 | VH-CH1 | Q39K/S183E | VK-CH1 | Q38E/S183K | VK-CK | Q38E/V133K | VH-CK | Q39K/V133E |
| 27-54 | VH-CH1 | Q39K/S183E | VK-CH1 | Q38K/S183K | VK-CK | Q38E/V133K | VH-CK | Q39E/V133E |

Example 30—Hexavalent, Trispecific Tetrahedral Antibodies Comprising the SIRPα Extracellular Domain (V2 Form), a Fab that Specifically Binds CD20, CD38, ERBB2, EGFR, or CEACAM5, and the CD40 ligand (CD40L)

Tetrahedral antibodies were designed, expressed, and evaluated for their ability to bind and block the CD47-SIRPα interaction, target CD20, CD38, ERBB2, EGFR, or CEACAM5-expressing cancer cells, and activate immune cellular signaling via the CD40 ligand-receptor interaction, for the treatment of cancer and related disease. This series of bispecific/trispecific constructs employ portions of the SIRPα extracellular region (V2 form), VH and VL regions from rituximab (anti-CD20), daratumumab (anti-CD38), trastuzumab (anti-ERBB2), cetuximab (anti-EGFR) and cergutuzumab (anti-CEACAM5), and optionally, a single-chain CD40 ligand trimer (CD40L) (Tables 79, 80). Three distinct configurations were evaluated (Table 81). In the first configuration, a portion of the SIRPα V2 form extracellular domain is placed in D3/D4, the cancer-targeting Fab, when present, is placed in D5/D6. In the second configuration, a portion of the SIRPα V2 form extracellular domain is placed in D3/D4, the cancer-targeting Fab, when present, is placed in D5/D6, and the CD40L is placed in D7/D8 by fusion to the H1 chain. In the third configuration, a portion of the SIRPα V2 form extracellular domain is placed in D3/D4, the cancer-targeting Fab, when present, is placed in D5/D6, and the CD40L is placed in D7/D8 by fusion to the Fc or H2 chain. To further facilitate purification of the correctly paired product by Protein A chromatography, for bivalent CD3, the H1 chain incorporates the H435R/Y436F substitution (for bivalent CD3); for monovalent CD3, both the H1 and H2 chains incorporate the H435R/Y436F substitution. The constructs are then evaluated for their structural bispecificity by intact mass spectrometry as described in Example 18, and for their functional bispecificity using a variety of in vitro binding assays, cytotoxicity assays, and cytokine induction and release assays, and in vivo cancer efficacy models, known to one skilled in the art.

TABLE 79

| Protein ID | H1 Chain | H2 Chain | L2 Chain | Fc Chain |
|---|---|---|---|---|
| 28-01 | SEQ ID NO: 5070 | | | SEQ ID NO: 5089 |
| 28-02 | SEQ ID NO: 5071 | | | SEQ ID NO: 5089 |
| 28-03 | SEQ ID NO: 5070 | SEQ ID NO: 5072 | SEQ ID NO: 5084 | |
| 28-04 | SEQ ID NO: 5071 | SEQ ID NO: 5072 | SEQ ID NO: 5084 | |
| 28-05 | SEQ ID NO: 5070 | SEQ ID NO: 5073 | SEQ ID NO: 5085 | |
| 28-06 | SEQ ID NO: 5071 | SEQ ID NO: 5073 | SEQ ID NO: 5085 | |
| 28-07 | SEQ ID NO: 5070 | SEQ ID NO: 5074 | SEQ ID NO: 5086 | |
| 28-08 | SEQ ID NO: 5071 | SEQ ID NO: 5074 | SEQ ID NO: 5086 | |
| 28-09 | SEQ ID NO: 5070 | SEQ ID NO: 5075 | SEQ ID NO: 5087 | |
| 28-10 | SEQ ID NO: 5071 | SEQ ID NO: 5075 | SEQ ID NO: 5087 | |
| 28-11 | SEQ ID NO: 5070 | SEQ ID NO: 5076 | SEQ ID NO: 5088 | |
| 28-12 | SEQ ID NO: 5071 | SEQ ID NO: 5076 | SEQ ID NO: 5088 | |
| 28-13 | SEQ ID NO: 5077 | | | SEQ ID NO: 5089 |
| 28-14 | SEQ ID NO: 5078 | | | SEQ ID NO: 5089 |
| 28-15 | SEQ ID NO: 5077 | SEQ ID NO: 5072 | SEQ ID NO: 5084 | |
| 28-16 | SEQ ID NO: 5078 | SEQ ID NO: 5072 | SEQ ID NO: 5084 | |
| 28-17 | SEQ ID NO: 5077 | SEQ ID NO: 5073 | SEQ ID NO: 5085 | |
| 28-18 | SEQ ID NO: 5078 | SEQ ID NO: 5073 | SEQ ID NO: 5085 | |
| 28-19 | SEQ ID NO: 5077 | SEQ ID NO: 5074 | SEQ ID NO: 5086 | |
| 28-20 | SEQ ID NO: 5078 | SEQ ID NO: 5074 | SEQ ID NO: 5086 | |
| 28-21 | SEQ ID NO: 5077 | SEQ ID NO: 5075 | SEQ ID NO: 5087 | |
| 28-22 | SEQ ID NO: 5078 | SEQ ID NO: 5075 | SEQ ID NO: 5087 | |
| 28-23 | SEQ ID NO: 5077 | SEQ ID NO: 5076 | SEQ ID NO: 5088 | |
| 28-24 | SEQ ID NO: 5078 | SEQ ID NO: 5076 | SEQ ID NO: 5088 | |
| 28-25 | SEQ ID NO: 5070 | | | SEQ ID NO: 5090 |
| 28-26 | SEQ ID NO: 5071 | | | SEQ ID NO: 5090 |
| 28-27 | SEQ ID NO: 5070 | SEQ ID NO: 5079 | SEQ ID NO: 5084 | |
| 28-28 | SEQ ID NO: 5071 | SEQ ID NO: 5079 | SEQ ID NO: 5084 | |
| 28-29 | SEQ ID NO: 5070 | SEQ ID NO: 5080 | SEQ ID NO: 5085 | |
| 28-30 | SEQ ID NO: 5071 | SEQ ID NO: 5080 | SEQ ID NO: 5085 | |
| 28-31 | SEQ ID NO: 5070 | SEQ ID NO: 5081 | SEQ ID NO: 5086 | |
| 28-32 | SEQ ID NO: 5071 | SEQ ID NO: 5081 | SEQ ID NO: 5086 | |
| 28-33 | SEQ ID NO: 5070 | SEQ ID NO: 5082 | SEQ ID NO: 5087 | |
| 28-34 | SEQ ID NO: 5071 | SEQ ID NO: 5082 | SEQ ID NO: 5087 | |
| 28-35 | SEQ ID NO: 5070 | SEQ ID NO: 5083 | SEQ ID NO: 5088 | |
| 28-36 | SEQ ID NO: 5071 | SEQ ID NO: 5083 | SEQ ID NO: 5088 | |

TABLE 80

| Protein ID | D1-Fc | D7-CD40L | D5-Fab | D4 | D3 | D6-Fab | D8-CD40L | D2-Fc |
|---|---|---|---|---|---|---|---|---|
| 28-01 | wild-type | | | SIRPα | SIRPα | | | wild-type |
| 28-02 | wild-type | | | SIRPα | SIRPα | | | wild-type |
| 28-03 | wild-type | | Rituximab | SIRPα | SIRPα | Rituximab | | wild-type |
| 28-04 | wild-type | | Rituximab | SIRPα | SIRPα | Rituximab | | wild-type |
| 28-05 | wild-type | | Daratumumab | SIRPα | SIRPα | Daratumumab | | wild-type |
| 28-06 | wild-type | | Daratumumab | SIRPα | SIRPα | Daratumumab | | wild-type |

TABLE 80-continued

| Protein ID | D1-Fc | D7-CD40L | D5-Fab | D4 | D3 | D6-Fab | D8-CD40L | D2-Fc |
|---|---|---|---|---|---|---|---|---|
| 28-07 | wild-type | | Trastuzumab | SIRPα | SIRPα | Trastuzumab | | wild-type |
| 28-08 | wild-type | | Trastuzumab | SIRPα | SIRPα | Trastuzumab | | wild-type |
| 28-09 | wild-type | | Cetuximab | SIRPα | SIRPα | Cetuximab | | wild-type |
| 28-10 | wild-type | | Cetuximab | SIRPα | SIRPα | Cetuximab | | wild-type |
| 28-11 | wild-type | | Cergutuzumab | SIRPα | SIRPα | Cergutuzumab | | wild-type |
| 28-12 | wild-type | | Cergutuzumab | SIRPα | SIRPα | Cergutuzumab | | wild-type |
| 28-13 | wild-type | H1 chain | | SIRPα | SIRPα | | H1 chain | wild-type |
| 28-14 | wild-type | H1 chain | | SIRPα | SIRPα | | H1 chain | wild-type |
| 28-15 | wild-type | H1 chain | Rituximab | SIRPα | SIRPα | Rituximab | H1 chain | wild-type |
| 28-16 | wild-type | H1 chain | Rituximab | SIRPα | SIRPα | Rituximab | H1 chain | wild-type |
| 28-17 | wild-type | H1 chain | Daratumumab | SIRPα | SIRPα | Daratumumab | H1 chain | wild-type |
| 28-18 | wild-type | H1 chain | Daratumumab | SIRPα | SIRPα | Daratumumab | H1 chain | wild-type |
| 28-19 | wild-type | H1 chain | Trastuzumab | SIRPα | SIRPα | Trastuzumab | H1 chain | wild-type |
| 28-20 | wild-type | H1 chain | Trastuzumab | SIRPα | SIRPα | Trastuzumab | H1 chain | wild-type |
| 28-21 | wild-type | H1 chain | Cetuximab | SIRPα | SIRPα | Cetuximab | H1 chain | wild-type |
| 28-22 | wild-type | H1 chain | Cetuximab | SIRPα | SIRPα | Cetuximab | H1 chain | wild-type |
| 28-23 | wild-type | H1 chain | Cergutuzumab | SIRPα | SIRPα | Cergutuzumab | H1 chain | wild-type |
| 28-24 | wild-type | H1 chain | Cergutuzumab | SIRPα | SIRPα | Cergutuzumab | H1 chain | wild-type |
| 28-25 | wild-type | Fc chain | | SIRPα | SIRPα | | Fc chain | wild-type |
| 28-26 | wild-type | Fc chain | | SIRPα | SIRPα | | Fc chain | wild-type |
| 28-27 | wild-type | H2 chain | Rituximab | SIRPα | SIRPα | Rituximab | H2 chain | wild-type |
| 28-28 | wild-type | H2 chain | Rituximab | SIRPα | SIRPα | Rituximab | H2 chain | wild-type |
| 28-29 | wild-type | H2 chain | Daratumumab | SIRPα | SIRPα | Daratumumab | H2 chain | wild-type |
| 28-30 | wild-type | H2 chain | Daratumumab | SIRPα | SIRPα | Daratumumab | H2 chain | wild-type |
| 28-31 | wild-type | H2 chain | Trastuzumab | SIRPα | SIRPα | Trastuzumab | H2 chain | wild-type |
| 28-32 | wild-type | H2 chain | Trastuzumab | SIRPα | SIRPα | Trastuzumab | H2 chain | wild-type |
| 28-33 | wild-type | H2 chain | Cetuximab | SIRPα | SIRPα | Cetuximab | H2 chain | wild-type |
| 28-34 | wild-type | H2 chain | Cetuximab | SIRPα | SIRPα | Cetuximab | H2 chain | wild-type |
| 28-35 | wild-type | H2 chain | Cergutuzumab | SIRPα | SIRPα | Cergutuzumab | H2 chain | wild-type |
| 28-36 | wild-type | H2 chain | Cergutuzumab | SIRPα | SIRPα | Cergutuzumab | H2 chain | wild-type |

TABLE 81

| Protein ID | D1-Fc Specificity | D7 Specificity | D5-Fab Specificity | D4 Specificity | D3 Specificity | D6-Fab Specificity | D8 Specificity | D2-Fc Specificity |
|---|---|---|---|---|---|---|---|---|
| 28-01 | FcgR | | | CD47 | CD47 | | | FcgR |
| 28-02 | FcgR | | | CD47 | CD47 | | | FcgR |
| 28-03 | FcgR | | CD20 | CD47 | CD47 | CD20 | | FcgR |
| 28-04 | FcgR | | CD20 | CD47 | CD47 | CD20 | | FcgR |
| 28-05 | FcgR | | CD38 | CD47 | CD47 | CD38 | | FcgR |
| 28-06 | FcgR | | CD38 | CD47 | CD47 | CD38 | | FcgR |
| 28-07 | FcgR | | ERBB1 | CD47 | CD47 | ERBB1 | | FcgR |
| 28-08 | FcgR | | ERBB1 | CD47 | CD47 | ERBB1 | | FcgR |
| 28-09 | FcgR | | EGFR | CD47 | CD47 | EGFR | | FcgR |
| 28-10 | FcgR | | EGFR | CD47 | CD47 | EGFR | | FcgR |
| 28-11 | FcgR | | CEACAM5 | CD47 | CD47 | CEACAM5 | | FcgR |
| 28-12 | FcgR | | CEACAM5 | CD47 | CD47 | CEACAM5 | | FcgR |
| 28-13 | FcgR | CD40 | | CD47 | CD47 | | CD40 | FcgR |
| 28-14 | FcgR | CD40 | | CD47 | CD47 | | CD40 | FcgR |
| 28-15 | FcgR | CD40 | CD20 | CD47 | CD47 | CD20 | CD40 | FcgR |
| 28-16 | FcgR | CD40 | CD20 | CD47 | CD47 | CD20 | CD40 | FcgR |
| 28-17 | FcgR | CD40 | CD38 | CD47 | CD47 | CD38 | CD40 | FcgR |
| 28-18 | FcgR | CD40 | CD38 | CD47 | CD47 | CD38 | CD40 | FcgR |
| 28-19 | FcgR | CD40 | ERBB1 | CD47 | CD47 | ERBB1 | CD40 | FcgR |
| 28-20 | FcgR | CD40 | ERBB1 | CD47 | CD47 | ERBB1 | CD40 | FcgR |
| 28-21 | FcgR | CD40 | EGFR | CD47 | CD47 | EGFR | CD40 | FcgR |
| 28-22 | FcgR | CD40 | EGFR | CD47 | CD47 | EGFR | CD40 | FcgR |
| 28-23 | FcgR | CD40 | CEACAM5 | CD47 | CD47 | CEACAM5 | CD40 | FcgR |
| 28-24 | FcgR | CD40 | CEACAM5 | CD47 | CD47 | CEACAM5 | CD40 | FcgR |
| 28-25 | FcgR | CD40 | | CD47 | CD47 | | CD40 | FcgR |
| 28-26 | FcgR | CD40 | | CD47 | CD47 | | CD40 | FcgR |
| 28-27 | FcgR | CD40 | CD20 | CD47 | CD47 | CD20 | CD40 | FcgR |
| 28-28 | FcgR | CD40 | CD20 | CD47 | CD47 | CD20 | CD40 | FcgR |
| 28-29 | FcgR | CD40 | CD38 | CD47 | CD47 | CD38 | CD40 | FcgR |
| 28-30 | FcgR | CD40 | CD38 | CD47 | CD47 | CD38 | CD40 | FcgR |
| 28-31 | FcgR | CD40 | ERBB1 | CD47 | CD47 | ERBB1 | CD40 | FcgR |
| 28-32 | FcgR | CD40 | ERBB1 | CD47 | CD47 | ERBB1 | CD40 | FcgR |
| 28-33 | FcgR | CD40 | EGFR | CD47 | CD47 | EGFR | CD40 | FcgR |
| 28-34 | FcgR | CD40 | EGFR | CD47 | CD47 | EGFR | CD40 | FcgR |
| 28-35 | FcgR | CD40 | CEACAM5 | CD47 | CD47 | CEACAM5 | CD40 | FcgR |
| 28-36 | FcgR | CD40 | CEACAM5 | CD47 | CD47 | CEACAM5 | CD40 | FcgR |

Example 31

To identify mutations that disrupt homodimerization of the collectrin-like domain, a series of variants are prepared in which each of amino acid residues Tyr633, Tyr641, Arg652, and Arg710 is independently substituted with lysine and glutamic acid. Each of the resulting variants is expressed as tetrahedral antibody of three different chains, an H1 chain, L1 chain, and Fc chain, as shown in FIG. 29A. Domains D1 and D2 are heterodimeric Fc domains formed by the H1 and Fc chains, and domains D3 and D4 are anti-CD19 FMC63 Fabs formed by the H1 and L1 chains. Table 82 summarizes the SEQ IDs of the H1, L1, and Fc chains used for the expression of each variant. Table 83 summarizes the amino acid substitutions at Tyr633, Tyr641, Arg652, and Arg710 for each variant. Table 83 also summarizes the predicted interaction between the first and second dimerizing polypeptides for each of the variants with respect to the cognate Arg710-Tyr633 and Arg652-Tyr641 pairs of the parent CLD dimerizing polypeptides from which they are derived.

Each tetrahedral antibody is evaluated for its ability to be expressed and secreted in CHO cells. Variants that are not expressed and secreted as homodimers are further evaluated for their ability to expressed and secreted as heterodimers via their co-expression together with other variants that are not expressed and secreted as homodimers.

TABLE 82

| Protein ID | H1 Chain | L2 Chain | Fc Chain |
|---|---|---|---|
| 29-01 | SEQ ID NO: 7765 | SEQ ID NO: 7846 | SEQ ID NO: 7847 |
| 29-02 | SEQ ID NO: 7766 | SEQ ID NO: 7846 | SEQ ID NO: 7847 |
| 29-03 | SEQ ID NO: 7767 | SEQ ID NO: 7846 | SEQ ID NO: 7847 |
| 29-04 | SEQ ID NO: 7768 | SEQ ID NO: 7846 | SEQ ID NO: 7847 |
| 29-05 | SEQ ID NO: 7769 | SEQ ID NO: 7846 | SEQ ID NO: 7847 |
| 29-06 | SEQ ID NO: 7770 | SEQ ID NO: 7846 | SEQ ID NO: 7847 |
| 29-07 | SEQ ID NO: 7771 | SEQ ID NO: 7846 | SEQ ID NO: 7847 |
| 29-08 | SEQ ID NO: 7772 | SEQ ID NO: 7846 | SEQ ID NO: 7847 |
| 29-09 | SEQ ID NO: 7773 | SEQ ID NO: 7846 | SEQ ID NO: 7847 |
| 29-10 | SEQ ID NO: 7774 | SEQ ID NO: 7846 | SEQ ID NO: 7847 |
| 29-11 | SEQ ID NO: 7775 | SEQ ID NO: 7846 | SEQ ID NO: 7847 |
| 29-12 | SEQ ID NO: 7776 | SEQ ID NO: 7846 | SEQ ID NO: 7847 |
| 29-13 | SEQ ID NO: 7777 | SEQ ID NO: 7846 | SEQ ID NO: 7847 |
| 29-14 | SEQ ID NO: 7778 | SEQ ID NO: 7846 | SEQ ID NO: 7847 |
| 29-15 | SEQ ID NO: 7779 | SEQ ID NO: 7846 | SEQ ID NO: 7847 |
| 29-16 | SEQ ID NO: 7780 | SEQ ID NO: 7846 | SEQ ID NO: 7847 |
| 29-17 | SEQ ID NO: 7781 | SEQ ID NO: 7846 | SEQ ID NO: 7847 |
| 29-18 | SEQ ID NO: 7782 | SEQ ID NO: 7846 | SEQ ID NO: 7847 |
| 29-19 | SEQ ID NO: 7783 | SEQ ID NO: 7846 | SEQ ID NO: 7847 |
| 29-20 | SEQ ID NO: 7784 | SEQ ID NO: 7846 | SEQ ID NO: 7847 |
| 29-21 | SEQ ID NO: 7785 | SEQ ID NO: 7846 | SEQ ID NO: 7847 |
| 29-22 | SEQ ID NO: 7786 | SEQ ID NO: 7846 | SEQ ID NO: 7847 |
| 29-23 | SEQ ID NO: 7787 | SEQ ID NO: 7846 | SEQ ID NO: 7847 |
| 29-24 | SEQ ID NO: 7788 | SEQ ID NO: 7846 | SEQ ID NO: 7847 |
| 29-25 | SEQ ID NO: 7789 | SEQ ID NO: 7846 | SEQ ID NO: 7847 |

TABLE 82-continued

| Protein ID | H1 Chain | L2 Chain | Fc Chain |
|---|---|---|---|
| 29-26 | SEQ ID NO: 7790 | SEQ ID NO: 7846 | SEQ ID NO: 7847 |
| 29-27 | SEQ ID NO: 7791 | SEQ ID NO: 7846 | SEQ ID NO: 7847 |
| 29-28 | SEQ ID NO: 7792 | SEQ ID NO: 7846 | SEQ ID NO: 7847 |
| 29-29 | SEQ ID NO: 7793 | SEQ ID NO: 7846 | SEQ ID NO: 7847 |
| 29-30 | SEQ ID NO: 7794 | SEQ ID NO: 7846 | SEQ ID NO: 7847 |
| 29-31 | SEQ ID NO: 7795 | SEQ ID NO: 7846 | SEQ ID NO: 7847 |
| 29-32 | SEQ ID NO: 7796 | SEQ ID NO: 7846 | SEQ ID NO: 7847 |
| 29-33 | SEQ ID NO: 7797 | SEQ ID NO: 7846 | SEQ ID NO: 7847 |
| 29-34 | SEQ ID NO: 7798 | SEQ ID NO: 7846 | SEQ ID NO: 7847 |
| 29-35 | SEQ ID NO: 7799 | SEQ ID NO: 7846 | SEQ ID NO: 7847 |
| 29-36 | SEQ ID NO: 7800 | SEQ ID NO: 7846 | SEQ ID NO: 7847 |
| 29-37 | SEQ ID NO: 7801 | SEQ ID NO: 7846 | SEQ ID NO: 7847 |
| 29-38 | SEQ ID NO: 7802 | SEQ ID NO: 7846 | SEQ ID NO: 7847 |
| 29-39 | SEQ ID NO: 7803 | SEQ ID NO: 7846 | SEQ ID NO: 7847 |
| 29-40 | SEQ ID NO: 7804 | SEQ ID NO: 7846 | SEQ ID NO: 7847 |
| 29-41 | SEQ ID NO: 7805 | SEQ ID NO: 7846 | SEQ ID NO: 7847 |
| 29-42 | SEQ ID NO: 7806 | SEQ ID NO: 7846 | SEQ ID NO: 7847 |
| 29-43 | SEQ ID NO: 7807 | SEQ ID NO: 7846 | SEQ ID NO: 7847 |
| 29-44 | SEQ ID NO: 7808 | SEQ ID NO: 7846 | SEQ ID NO: 7847 |
| 29-45 | SEQ ID NO: 7809 | SEQ ID NO: 7846 | SEQ ID NO: 7847 |
| 29-46 | SEQ ID NO: 7810 | SEQ ID NO: 7846 | SEQ ID NO: 7847 |
| 29-47 | SEQ ID NO: 7811 | SEQ ID NO: 7846 | SEQ ID NO: 7847 |
| 29-48 | SEQ ID NO: 7812 | SEQ ID NO: 7846 | SEQ ID NO: 7847 |
| 29-49 | SEQ ID NO: 7813 | SEQ ID NO: 7846 | SEQ ID NO: 7847 |
| 29-50 | SEQ ID NO: 7814 | SEQ ID NO: 7846 | SEQ ID NO: 7847 |
| 29-51 | SEQ ID NO: 7815 | SEQ ID NO: 7846 | SEQ ID NO: 7847 |
| 29-52 | SEQ ID NO: 7816 | SEQ ID NO: 7846 | SEQ ID NO: 7847 |
| 29-53 | SEQ ID NO: 7817 | SEQ ID NO: 7846 | SEQ ID NO: 7847 |
| 29-54 | SEQ ID NO: 7818 | SEQ ID NO: 7846 | SEQ ID NO: 7847 |
| 29-55 | SEQ ID NO: 7819 | SEQ ID NO: 7846 | SEQ ID NO: 7847 |
| 29-56 | SEQ ID NO: 7820 | SEQ ID NO: 7846 | SEQ ID NO: 7847 |
| 29-57 | SEQ ID NO: 7821 | SEQ ID NO: 7846 | SEQ ID NO: 7847 |
| 29-58 | SEQ ID NO: 7822 | SEQ ID NO: 7846 | SEQ ID NO: 7847 |
| 29-59 | SEQ ID NO: 7823 | SEQ ID NO: 7846 | SEQ ID NO: 7847 |
| 29-60 | SEQ ID NO: 7824 | SEQ ID NO: 7846 | SEQ ID NO: 7847 |
| 29-61 | SEQ ID NO: 7825 | SEQ ID NO: 7846 | SEQ ID NO: 7847 |
| 29-62 | SEQ ID NO: 7826 | SEQ ID NO: 7846 | SEQ ID NO: 7847 |
| 29-63 | SEQ ID NO: 7827 | SEQ ID NO: 7846 | SEQ ID NO: 7847 |
| 29-64 | SEQ ID NO: 7828 | SEQ ID NO: 7846 | SEQ ID NO: 7847 |
| 29-65 | SEQ ID NO: 7829 | SEQ ID NO: 7846 | SEQ ID NO: 7847 |
| 29-66 | SEQ ID NO: 7830 | SEQ ID NO: 7846 | SEQ ID NO: 7847 |
| 29-67 | SEQ ID NO: 7831 | SEQ ID NO: 7846 | SEQ ID NO: 7847 |
| 29-68 | SEQ ID NO: 7832 | SEQ ID NO: 7846 | SEQ ID NO: 7847 |
| 29-69 | SEQ ID NO: 7833 | SEQ ID NO: 7846 | SEQ ID NO: 7847 |
| 29-70 | SEQ ID NO: 7834 | SEQ ID NO: 7846 | SEQ ID NO: 7847 |
| 29-71 | SEQ ID NO: 7835 | SEQ ID NO: 7846 | SEQ ID NO: 7847 |
| 29-72 | SEQ ID NO: 7836 | SEQ ID NO: 7846 | SEQ ID NO: 7847 |
| 29-73 | SEQ ID NO: 7837 | SEQ ID NO: 7846 | SEQ ID NO: 7847 |
| 29-74 | SEQ ID NO: 7838 | SEQ ID NO: 7846 | SEQ ID NO: 7847 |
| 29-75 | SEQ ID NO: 7839 | SEQ ID NO: 7846 | SEQ ID NO: 7847 |
| 29-76 | SEQ ID NO: 7840 | SEQ ID NO: 7846 | SEQ ID NO: 7847 |
| 29-77 | SEQ ID NO: 7841 | SEQ ID NO: 7846 | SEQ ID NO: 7847 |
| 29-78 | SEQ ID NO: 7842 | SEQ ID NO: 7846 | SEQ ID NO: 7847 |
| 29-79 | SEQ ID NO: 7843 | SEQ ID NO: 7846 | SEQ ID NO: 7847 |
| 29-80 | SEQ ID NO: 7844 | SEQ ID NO: 7846 | SEQ ID NO: 7847 |
| 29-81 | SEQ ID NO: 7845 | SEQ ID NO: 7846 | SEQ ID NO: 7847 |

TABLE 83

| | Amino Acid Substitution | | | | Predicted Interaction | |
|---|---|---|---|---|---|---|
| Protein ID | Tyr633 | Tyr641 | Arg652 | Arg710 | Arg710-Tyr633 | Arg652-Tyr641 |
| 29-01 | Y | Y | R | R | cation-π | cation-π |
| 29-02 | K | Y | R | R | cation-cation | cation-π |
| 29-03 | E | Y | R | R | cation-anion | cation-π |
| 29-04 | Y | Y | R | K | cation-π (weak) | cation-π |
| 29-05 | K | Y | R | K | cation-cation | cation-π |
| 29-06 | E | Y | R | K | cation-anion | cation-π |
| 29-07 | Y | Y | R | E | anion-π (weak) | cation-π |
| 29-08 | K | Y | R | E | anion-cation | cation-π |
| 29-09 | E | Y | R | E | anion-anion | cation-π |
| 29-10 | Y | K | R | R | cation-π | cation-cation |

TABLE 83-continued

| | Amino Acid Substitution | | | | Predicted Interaction | |
|---|---|---|---|---|---|---|
| Protein ID | Tyr633 | Tyr641 | Arg652 | Arg710 | Arg710-Tyr633 | Arg652-Tyr641 |
| 29-11 | K | K | R | R | cation-cation | cation-cation |
| 29-12 | E | K | R | R | cation-anion | cation-cation |
| 29-13 | Y | K | R | K | cation-π (weak) | cation-cation |
| 29-14 | K | K | R | K | cation-cation | cation-cation |
| 29-15 | E | K | R | K | cation-anion | cation-cation |
| 29-16 | Y | K | R | E | anion-π (weak) | cation-cation |
| 29-17 | K | K | R | E | anion-cation | cation-cation |
| 29-18 | E | K | R | E | anion-anion | cation-cation |
| 29-19 | Y | E | R | R | cation-π | cation-anion |
| 29-20 | K | E | R | R | cation-cation | cation-anion |
| 29-21 | E | E | R | R | cation-anion | cation-anion |
| 29-22 | Y | E | R | K | cation-π (weak) | cation-anion |
| 29-23 | K | E | R | K | cation-cation | cation-anion |
| 29-24 | E | E | R | K | cation-anion | cation-anion |
| 29-25 | Y | E | R | E | anion-π (weak) | cation-anion |
| 29-26 | K | E | R | E | anion-cation | cation-anion |
| 29-27 | E | E | R | E | anion-anion | cation-anion |
| 29-28 | Y | Y | K | R | cation-π | cation-π (weak) |
| 29-29 | K | Y | K | R | cation-cation | cation-π (weak) |
| 29-30 | E | Y | K | R | cation-anion | cation-π (weak) |
| 29-31 | Y | Y | K | K | cation-π (weak) | cation-π (weak) |
| 29-32 | K | Y | K | K | cation-cation | cation-π (weak) |
| 29-33 | E | Y | K | K | cation-anion | cation-π (weak) |
| 29-34 | Y | Y | K | E | anion-π (weak) | cation-π (weak) |
| 29-35 | K | Y | K | E | anion-cation | cation-π (weak) |
| 29-36 | E | Y | K | E | anion-anion | cation-π (weak) |
| 29-37 | Y | K | K | R | cation-π | cation-cation |
| 29-38 | K | K | K | R | cation-cation | cation-cation |
| 29-39 | E | K | K | R | cation-anion | cation-cation |
| 29-40 | Y | K | K | K | cation-π (weak) | cation-cation |
| 29-41 | K | K | K | K | cation-cation | cation-cation |
| 29-42 | E | K | K | K | cation-anion | cation-cation |
| 29-43 | Y | K | K | E | anion-π (weak) | cation-cation |
| 29-44 | K | K | K | E | anion-cation | cation-cation |
| 29-45 | E | K | K | E | anion-anion | cation-cation |
| 29-46 | Y | E | K | R | cation-π | cation-anion |
| 29-47 | K | E | K | R | cation-cation | cation-anion |
| 29-48 | E | E | K | R | cation-anion | cation-anion |
| 29-49 | Y | E | K | K | cation-π (weak) | cation-anion |
| 29-50 | K | E | K | K | cation-cation | cation-anion |
| 29-51 | E | E | K | K | cation-anion | cation-anion |
| 29-52 | Y | E | K | E | anion-π (weak) | cation-anion |
| 29-53 | K | E | K | E | anion-cation | cation-anion |
| 29-54 | E | E | K | E | anion-anion | cation-anion |
| 29-55 | Y | Y | E | R | cation-π | anion-π (weak) |
| 29-56 | K | Y | E | R | cation-cation | anion-π (weak) |
| 29-57 | E | Y | E | R | cation-anion | anion-π (weak) |
| 29-58 | Y | Y | E | K | cation-π (weak) | anion-π (weak) |
| 29-59 | K | Y | E | K | cation-cation | anion-π (weak) |
| 29-60 | E | Y | E | K | cation-anion | anion-π (weak) |
| 29-61 | Y | Y | E | E | anion-π (weak) | anion-π (weak) |
| 29-62 | K | Y | E | E | anion-cation | anion-π (weak) |
| 29-63 | E | Y | E | E | anion-anion | anion-π (weak) |
| 29-64 | Y | K | E | R | cation-π | anion-cation |
| 29-65 | K | K | E | R | cation-cation | anion-cation |
| 29-66 | E | K | E | R | cation-anion | anion-cation |
| 29-67 | Y | K | E | K | cation-π (weak) | anion-cation |
| 29-68 | K | K | E | K | cation-cation | anion-cation |
| 29-69 | E | K | E | K | cation-anion | anion-cation |
| 29-70 | Y | K | E | E | anion-π (weak) | anion-cation |
| 29-71 | K | K | E | E | anion-cation | anion-cation |
| 29-72 | E | K | E | E | anion-anion | anion-cation |
| 29-73 | Y | E | E | R | cation-π | anion-anion |
| 29-74 | K | E | E | R | cation-cation | anion-anion |
| 29-75 | E | E | E | R | cation-anion | anion-anion |
| 29-76 | Y | E | E | K | cation-π (weak) | anion-anion |
| 29-77 | K | E | E | K | cation-cation | anion-anion |
| 29-78 | E | E | E | K | cation-anion | anion-anion |
| 29-79 | Y | E | E | E | anion-π (weak) | anion-anion |
| 29-80 | K | E | E | E | anion-cation | anion-anion |
| 29-81 | E | E | E | E | anion-anion | anion-anion |

Example 32

Figure 52:
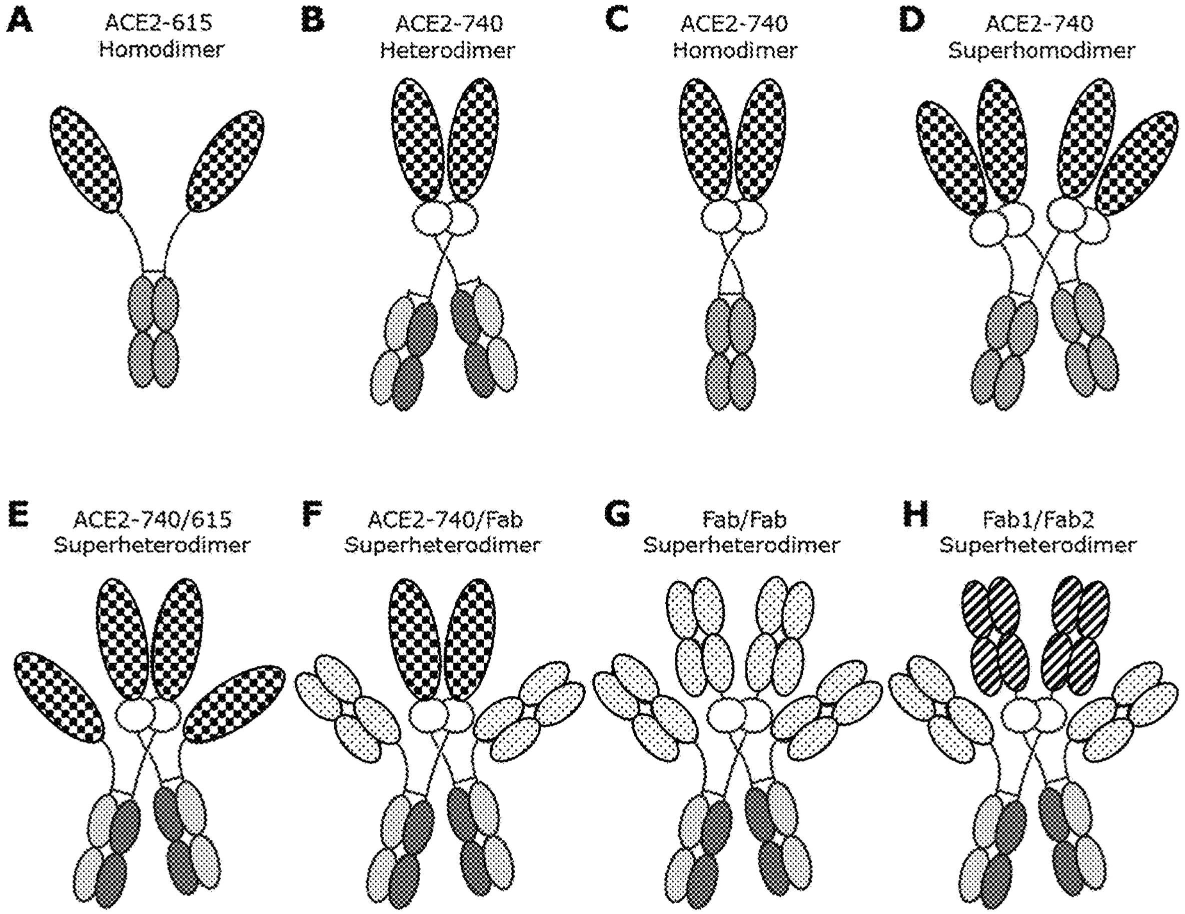
FIG. 52: General structures of the topologically distinct molecules described in Example 32. Panels A to C depict ACE2-Fc dimers in which dimerization is driven (A) solely by the Fc domain, (B) solely by the collectrin-like domain, or (C) by both the Fc domain and collectrin-like domain. In panel D, the ACE2-740 superhomodimer is produced by cross-dimerization of the Fc and collectrin-like domains. Panels E to H depict various GEM-DIMERs (superheterodimers) featuring (E) four ACE2 domains, (F) two ACE2 domains and two Fab domains, (G) four Fab domains of a single type, and (H) four Fab domains of two distinct types. The collectrin-like domain is represented by white circles, the ACE2 peptidase domain by checkerboard ovals, distinct types of Fab domains by dotted and vertically lined ovals, Fc homodimers by gray ovals, and Fc heterodimers by light gray/dark gray ovals. Various strategies may be used to ensure Fc heterodimer formation and proper pairing of immunoglobulin heavy and light chains, including steric complementarity, domain crossovers, and electrostatic steering effects.

FIG. 52 illustrates the structures of the molecules of this Example. Structures were confirmed by specific cleavage by IdeZ protease and multi-angle light scattering coupled with size-exclusion chromatography (SEC-MALS) (FIGS. 57-59, FIG. 84). Panels A to C of FIG. 52 illustrate three topologically distinct types of ACE2 dimers that are formed when dimerization is driven solely by the Fc domain (Panel A), solely by the ACE2 collectrin-like domain (Panel B), or by both the Fc and collectrin-like domains (Panel C). The first construct (ACE2-615 homodimer) and second construct (ACE2-740 heterodimer) were each produced as a single species. It was discovered that the third construct was a mixture of two topologically distinct forms (Panel A of FIG. 53). The smaller form is the predicted ACE2-740 homodimer (Panel C of FIG. 52). The larger form is an ACE2-740 superhomodimer (Panel D of FIG. 52), featuring a novel topology reflecting cross-dimerization of its two pairs of CLD dimerizing polypeptides and two pairs of Fc dimerizing polypeptides. The structure of the superdimer suggests a tetrahedral-like configuration formed by the outward projection of its two ACE2 peptidase dimers (8-10) and two Fc dimers from a central "nucleus".

Figure 60:
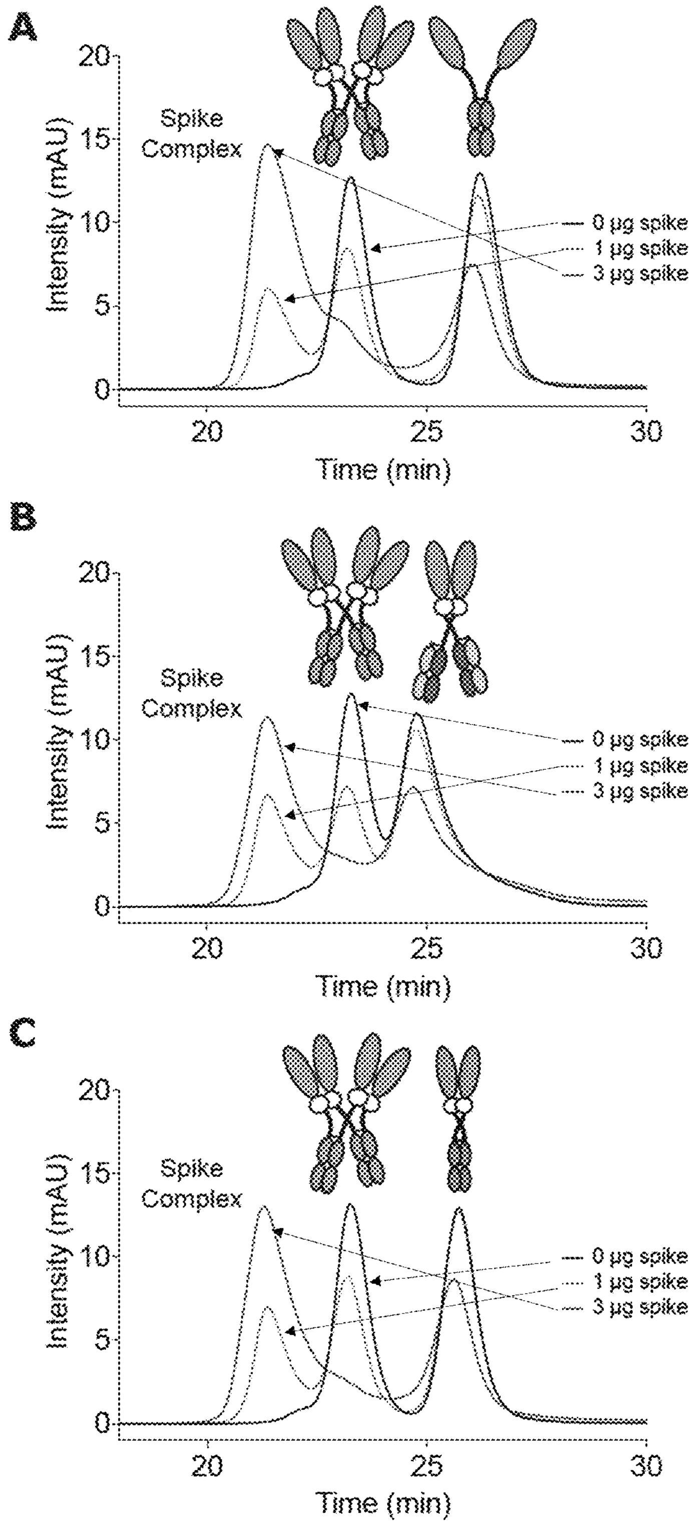
FIG. 60: Order-of-binding analysis demonstrates that ACE2 superdimer-spike complexes form at the expense of ACE2 dimer-spike complexes. Titrations with aggregate-free spike trimer were carried out using mixtures of purified ACE2-740 superhomodimer (Panel D of FIG. 52) with purified preparations of the following ACE2 dimers: (A) ACE2-615 homodimer (Panel A of FIG. 52), (B) ACE2-740 heterodimer (Panel B of FIG. 52), and (C) ACE2-740 homodimer (Panel C of FIG. 52).

Stoichiometric competition binding studies revealed extraordinary activity associated with the superdimer. When impure mixtures of ACE2-740 superhomodimer and ACE2-740 homodimer were titrated with limiting amounts of aggregate-free, individual spike trimers, a preferred "order-of-binding" was observed in which superdimer-spike complexes formed at the expense of dimer-spike complexes (Panel D of FIG. 53). Similar results were obtained for equimolar mixtures of purified ACE2-740 superhomodimer with each of the three topologically distinct ACE2 dimers shown in Panels A to C of FIG. 52 (FIG. 60).

Panels E to H of FIG. 52 illustrate "superheterodimers" that can be produced as a single topological form rather than mixtures by limiting the constructs to a single pair of CLD-dimerizing polypeptides. These constructs are referred to as GEM-DIMERs™ (Gemini dimers) given their twin-like structures. GEM-DIMERs may comprise any combination of antibodies and Fc-fusion proteins. Notably, the bispecific GEM-DIMERs shown in panels F and H can be engineered in two distinct configurations depending on which of the Fab or fusion protein domains (e.g., ACE2) is connected directly to the collectrin-like domain, and which is connected directly to the Fc domain. This structural distinction can have important functional consequences as demonstrated below.

Figure 53:
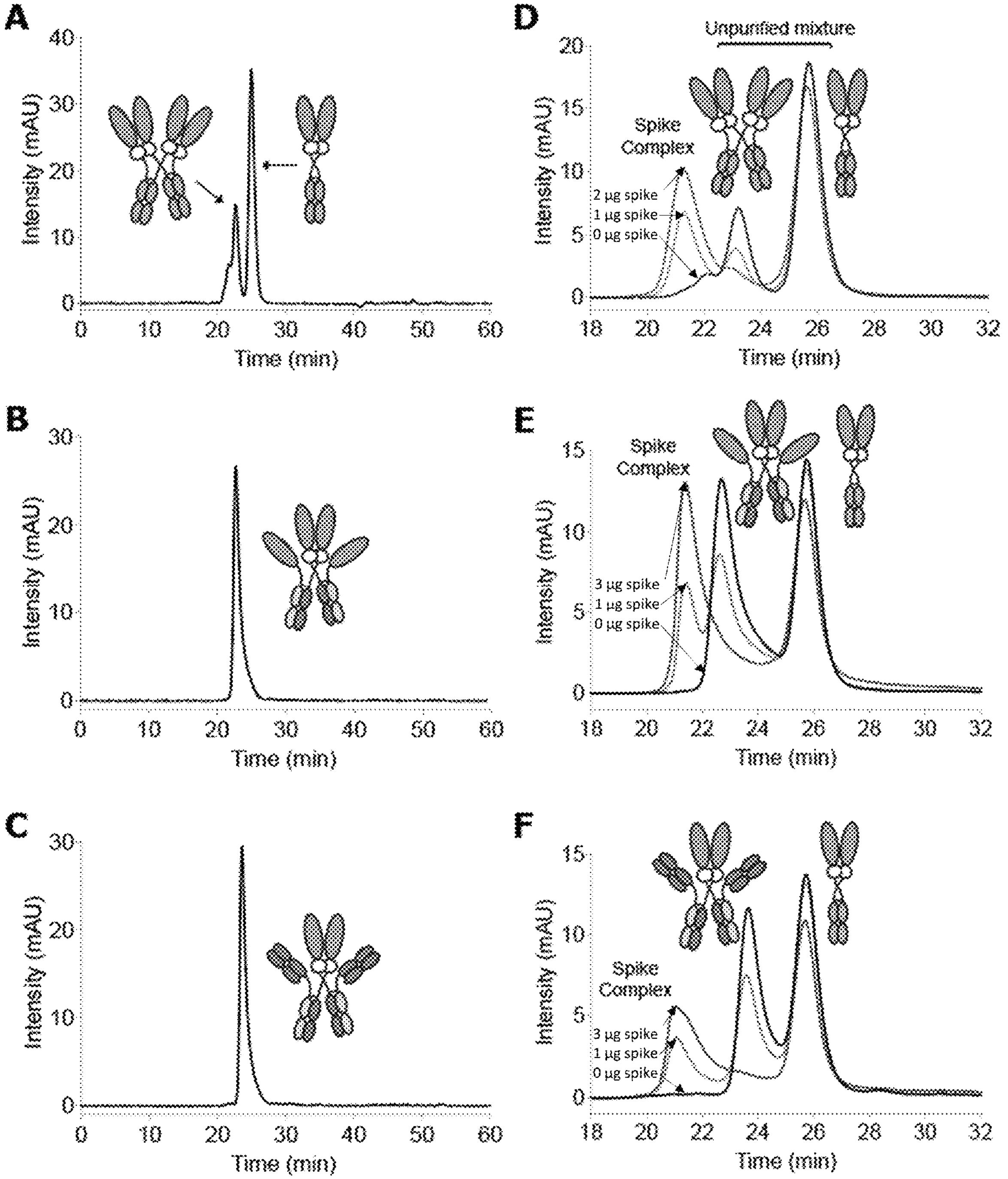
FIG. 53: ACE2 superdimers demonstrate an extraordinary ability to bind individual spike trimers and neutralize live SARS-CoV-2 compared to ACE2 dimers. Panels A to C depict size-exclusion HPLC (SE-HPLC) analysis showing that (A) ACE2-740 superhomodimer and ACE2-740 homodimer are co-secreted as a mixture of two species; (B) ACE2-740/615 superheterodimer and (C) ACE2-740/B13A superheterodimer are each secreted as a single species. Panels D to F depict stoichiometric binding analysis showing that superdimer-spike complexes form at the expense of dimer-spike complexes. Titrations with aggregate-free, individual spike trimer were carried out with superdimer/dimer mixtures: panel D depicts the mixture of ACE2-740 superhomodimer and ACE2-740 homodimer that is naturally co-secreted by cells, panel E depicts an equimolar mixture of pure ACE2-740/615 superheterodimer and pure ACE2-740 homodimer, panel F depicts an equimolar mixture of pure ACE2-740/B13A superheterodimer and pure ACE2-740 homodimer.

Panels B and C of FIG. 53 show that ACE2-740/615 superheterodimer (Panel E of FIG. 52), with four ACE2 peptidase domains, and ACE2-740/B13A superheterodimer (Panel F of FIG. 52), with two ACE2 peptidase domains and two Fab domains from the anti-spike B13A antibody (11), are each produced as a single species. ACE2-740/615 superheterodimer and ACE2-740/B13A superheterodimer demonstrate highly potent binding to individual spike trimers, comparable to ACE2-740 superhomodimer (Panels E to F of FIG. 53). The qualitative results from our competition binding experiments were confirmed by quantitative solution binding analysis (FIG. 85). The three topologically distinct ACE2 dimers, ACE2-615 homodimer, ACE2-740 heterodimer, and ACE2-740 homodimer, bound spike protein with a $K_D$ of 1.56 nM, 1.92 nM, and 1.39 nM, respectively. ACE2-740 superhomodimer, ACE2-740/615 superheterodimer, and ACE2-740/B13A superheterodimer bound spike protein with a $K_D$ of 27.2 pM, 26.7 pM and 15.8 pM, respectively. These results demonstrate a cooperative binding advantage of ACE2 superdimers over ACE2 dimers of 51- to 126-fold.

Figure 54:
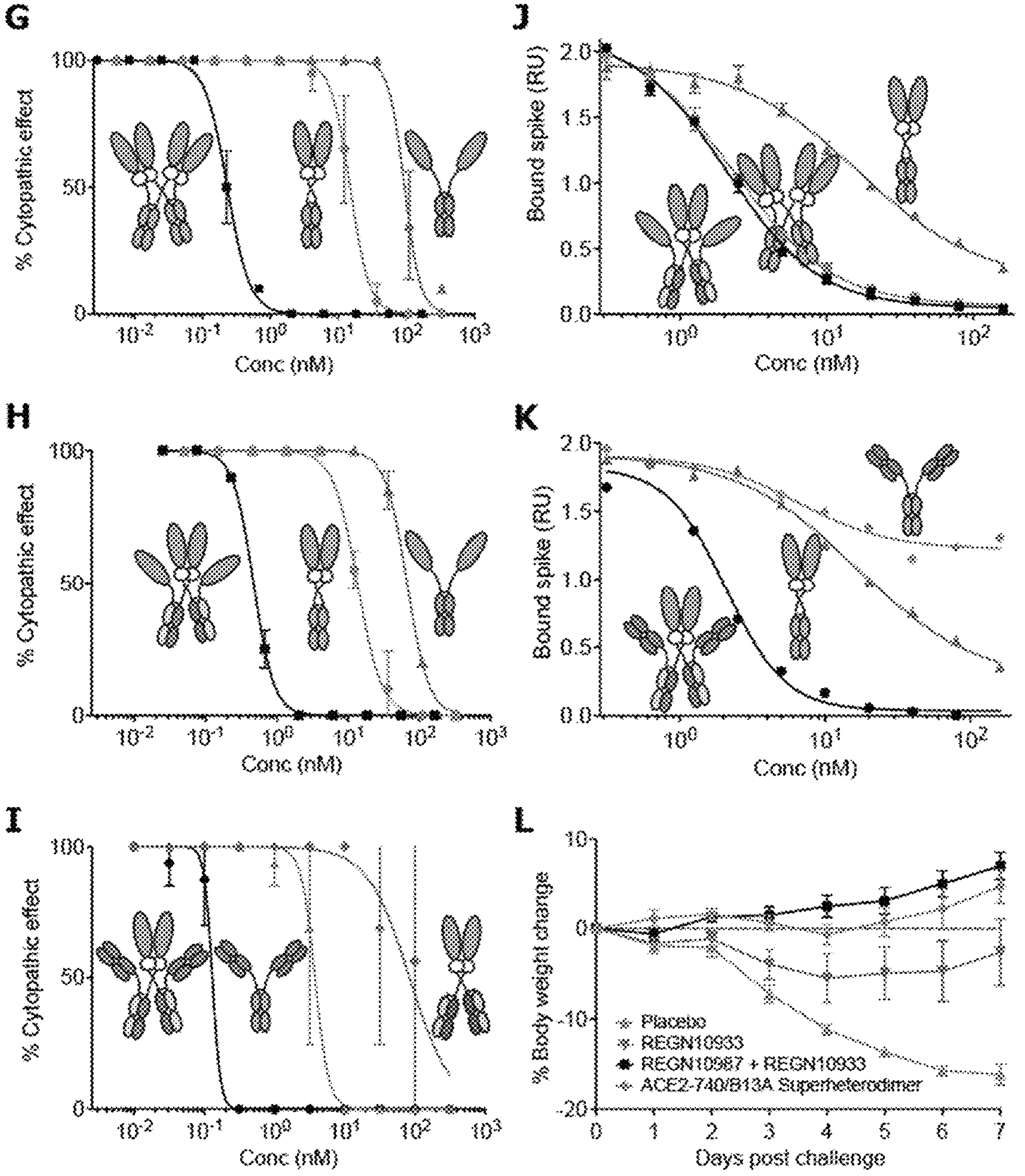
FIG. 54: ACE2 superdimers demonstrate an extraordinary ability to bind individual spike trimers and neutralize live SARS-CoV-2 compared to ACE2 dimers. Panels G to I depict neutralization of live SARS-CoV-2 virus by: (G) ACE2-740 superhomodimer, ACE2-740 homodimer, ACE2-615 homodimer; (H) ACE2-740/615 superheterodimer, ACE2-740 homodimer, ACE2-615 homodimer; (I) ACE2-740/B13A superheterodimer, B13A antibody, ACE2-740 heterodimer. Panels J to K depict neutralization of aggregate-free, individual spike trimer binding to cell surface ACE2 by: (J) ACE2-740/615 superheterodimer, ACE2-740 superhomodimer, ACE2-740 homodimer; (K) ACE2-740/B13A superheterodimer, ACE2-740 homodimer, B13A antibody. Panel L depicts efficacy of ACE2-740/B13A superheterodimer in an in vivo prophylactic model of SARS-CoV-2 infection. Golden hamsters were treated by intraperitoneal injection on day-1, challenged intranasally with $1.09\times10^5$ PFU of the Beta B.1.351 variant on day 0, and evaluated for weight loss/gain. ACE2-740/B13A superheterodimer vs. placebo ($p<0.0001$); ACE2-740/B13A superheterodimer vs. REGN10987+REGN10933 (p=NS); REGN10933 alone vs. placebo ($P=0.0775$).
Figure 55:
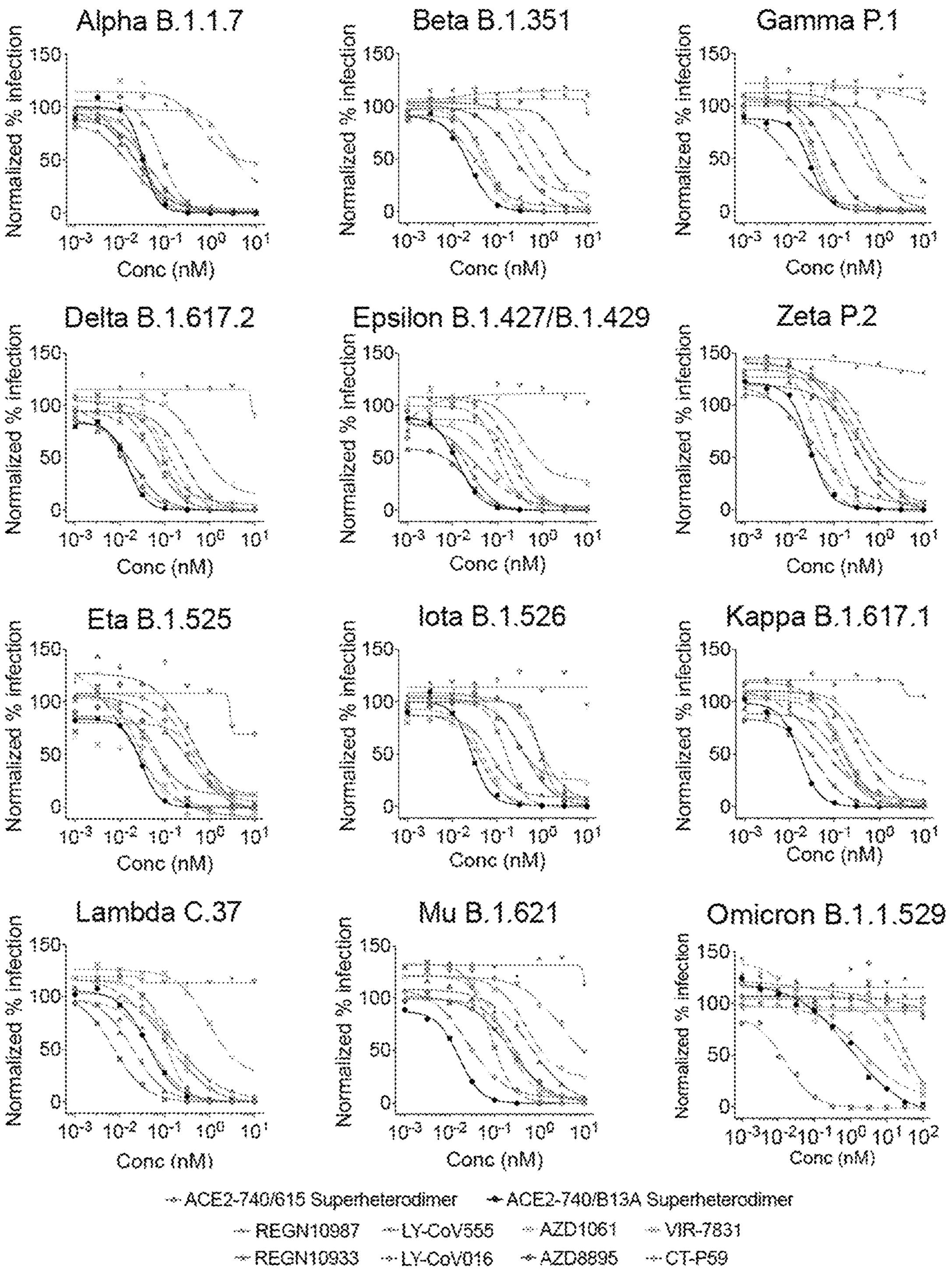
FIG. 55: ACE2-740/615 superheterodimer (HB1507; Protein ID 15-07) and ACE2-740/B13A superheterodimer (HB1516; Protein ID 15-16) demonstrate extraordinary activity against twelve major SARS-CoV-2 variants. Pseudovirus neutralization activity of HB1507 (panel E of FIG. 52) and HB1516 (panel F of FIG. 52) compared with eight clinically authorized antibodies (REGN10987, REGN10933, LY-CoV555, LY-CoV016, AZD1061, AZD8895, VIR-7831, CT-P59) against the Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529 variants.
Figure 61:
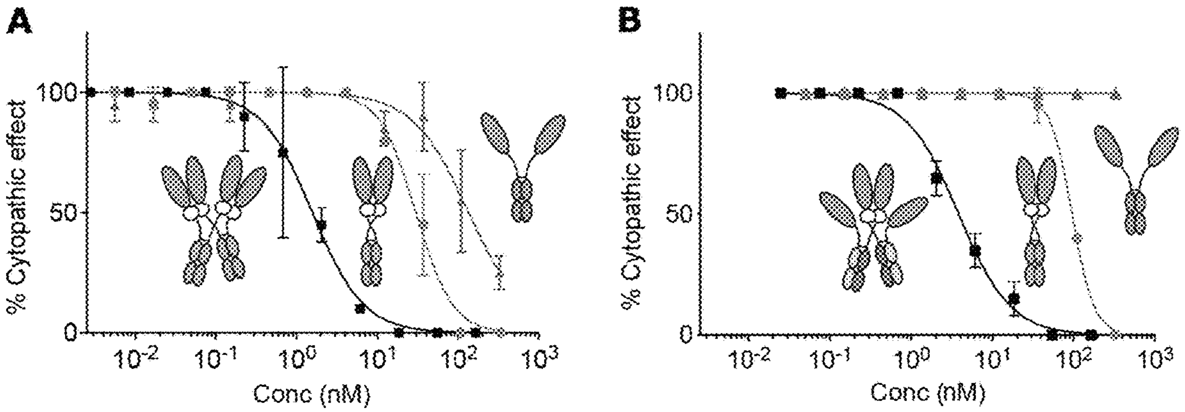
FIG. 61: Neutralization of live NL63 alphacoronavirus by ACE2 superdimers compared to ACE2 dimers. Neutralization of live NL63 virus infection by: (A) ACE2-740 superhomodimer (squares), ACE2-740 homodimer (circles), ACE2-615 homodimer (triangles), and (B) ACE2-740/615 superheterodimer (squares), ACE2-740 homodimer (circles) ACE2-615 homodimer (triangles).

To assess our ACE2 superdimers as candidates for treatment of COVID-19 and other ACE2 utilizing viruses, their ability to neutralize live SARS-CoV-2 betacoronavirus and NL63 alphacoronavirus was compared (Panels G to I of FIG. 54, FIG. 61, FIG. 86). The results recapitulate the relative potencies of superdimers and dimers in our solution binding studies (FIG. 85). ACE2-740 superhomodimer and ACE2-740/615 superheterodimer demonstrate 403-fold and 143-fold greater potency than ACE2-615 homodimer against SARS-CoV-2, and 87-fold and >78-fold greater potency against NL63. ACE2-740/B13A superheterodimer demonstrates 646-fold and 29-fold greater potency against SARS-CoV-2 compared with ACE2-740 heterodimer and B13A antibody, respectively. The ability of ACE2 superdimers and dimers to neutralize spike protein binding to cell surface ACE2 receptors was also compared (Panels J to K of FIG. 53, FIG. 87). ACE2-740 superhomodimer and ACE2-740/615 superheterodimer neutralized spike binding with a cooperative binding advantage over ACE2-740 homodimer of 8.9-fold and 10.6-fold. ACE2-740/B13A superheterodimer neutralized spike binding with a cooperative binding advantage over ACE2-740 homodimer and B13A antibody of 11.2-fold and 3.8-fold. ACE2-740/B13A superheterodimer was further evaluated using an in vivo prophylactic model of SARS-CoV-2 infection in golden Syrian hamsters (12). Panel L of FIG. 53 demonstrates that ACE2-740/B13A superheterodimer (25 mg/kg) exhibits comparable efficacy in preventing weight-loss compared to a two-antibody cocktail of REGN10987 (25 mg/kg) and REGN10933 (25 mg/kg), and superior efficacy to REGN10933 alone (25 mg/kg).

Figure 62:
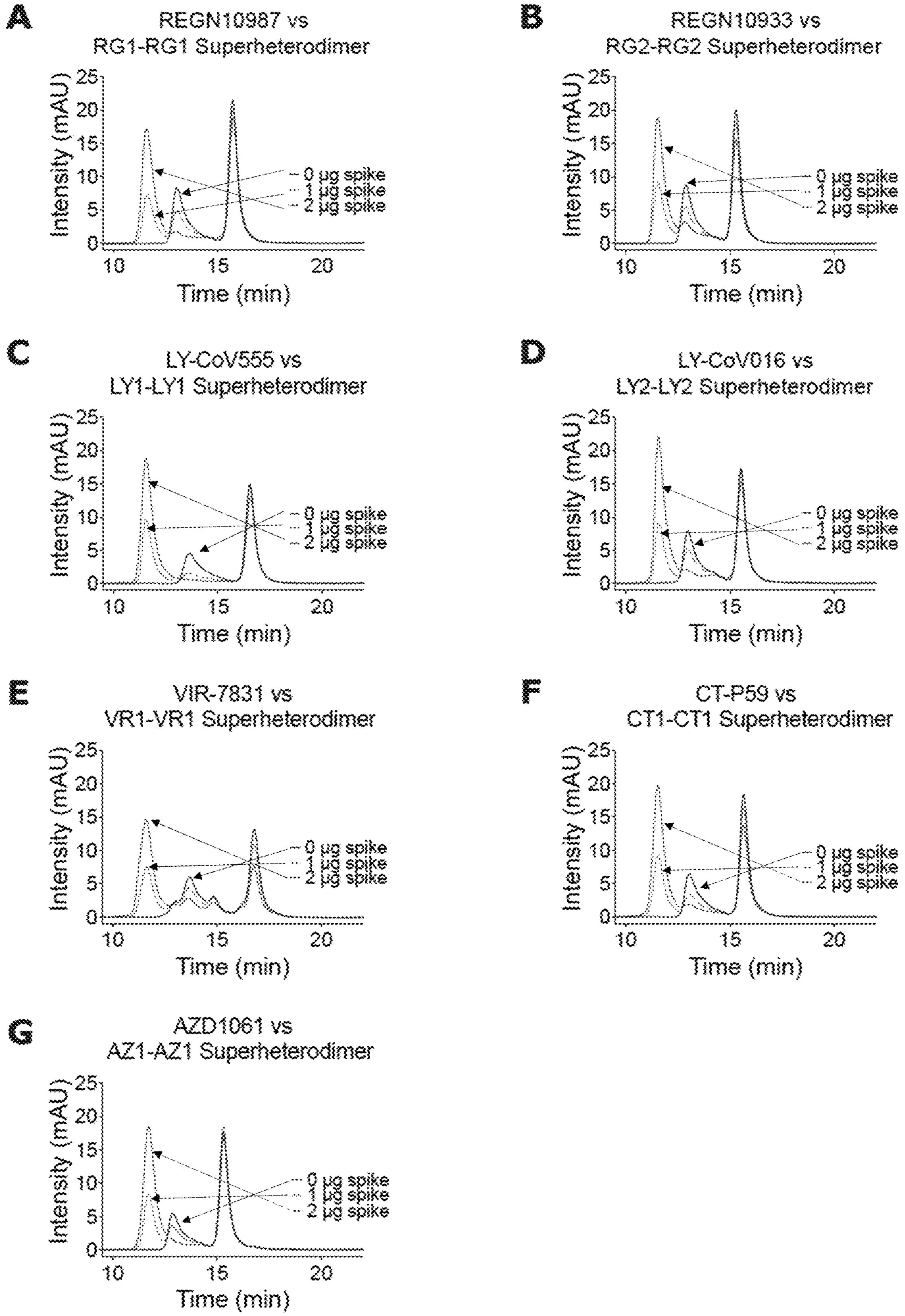
FIG. 62: Stoichiometric competition binding analysis of Fab/Fab superheterodimers compared to their parent antibodies. Titrations with aggregate-free, individual spike trimer were carried out with the following mixtures of antibody Fab/Fab superheterodimers (Panel G of FIG. 52) and their parent antibodies: (A) RG1-RG1 and REGN10987, (B) RG2-RG2 and REGN10933, (C) LY1-LY1 and LY-CoV555, (D) LY2-LY2 and LY-CoV016, (E) VR1-VR1 and VIR-7831, (F) CT1-CT1 and CT-P59, (G) AZ1-AZ1 and AZD1061.
Figure 63:
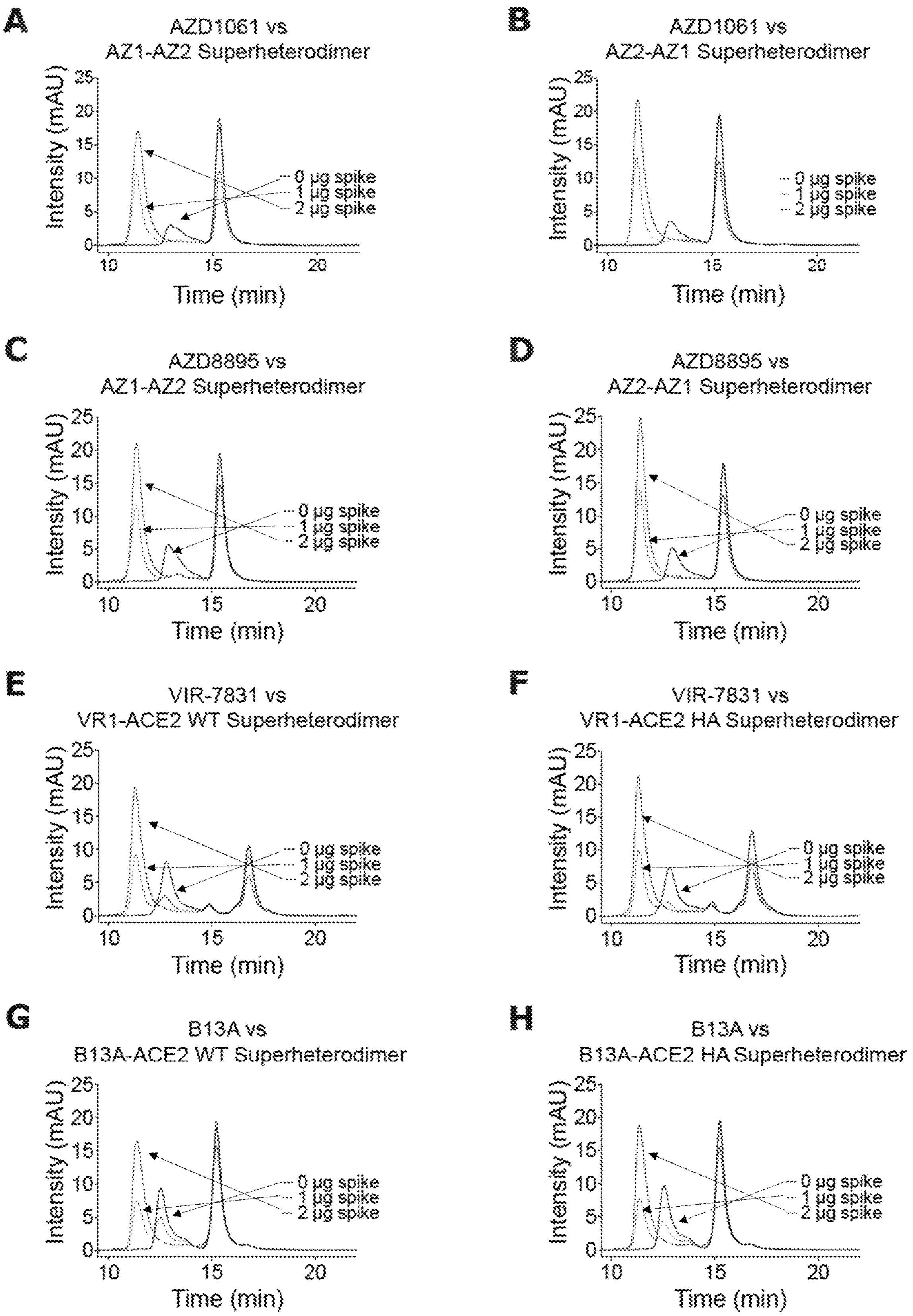
FIG. 63: Stoichiometric competition binding analysis of bispecific Fab1/Fab2 superheterodimers and ACE2-740/Fab superheterodimers compared to their parent antibodies. Titrations with aggregate-free, individual spike trimer were carried out with the following mixtures of bispecific Fab1/Fab2 superheterodimers (Panel H of FIG. 52) or ACE2-740/Fab superheterodimers (Panel F of FIG. 52) and their parent antibodies: (A) AZ1-AZ2 and AZD1061, (B) AZ2-AZ1 and AZD1061, (C) AZ1-AZ2 and AZD8895, (D) AZ2-AZ1 and AZD8895, (E) VR1-ACE2 WT and VIR-7831, (F) VR1-ACE2 HA and VIR-7831, (G) B13A-ACE2 WT and B13A, and (H) B13A-ACE2 WT and B13A. Abbreviations: ACE2 WT, ACE2 with wild-type angiotensin-converting activity; ACE2 HA, ACE2 with H378A mutation which abrogates angiotensin-converting activity.
Figure 64:
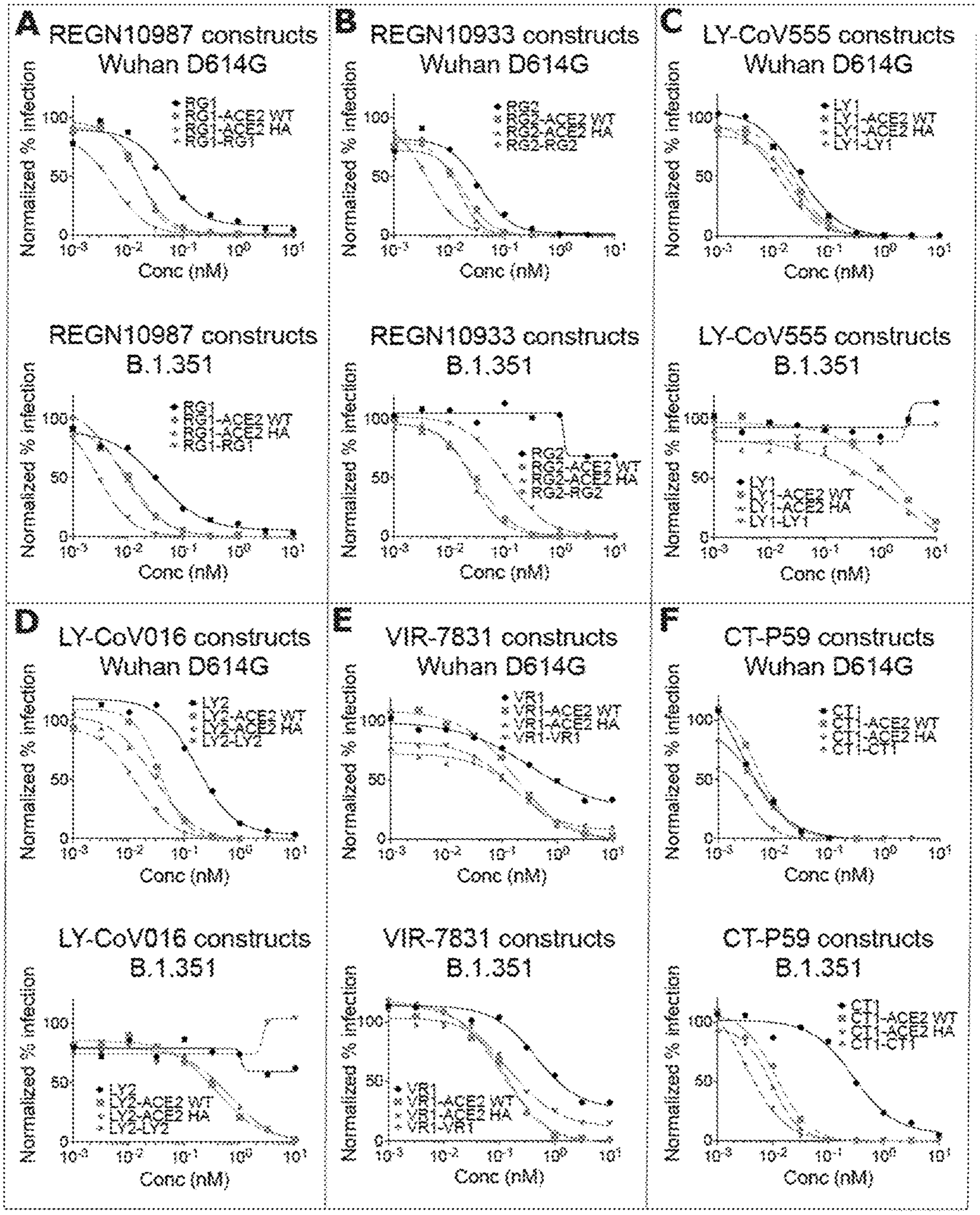
FIG. 64: Pseudovirus neutralizing activity of ACE2-740/Fab superheterodimers and antibody Fab/Fab superheterodimers compared with their parent antibodies. Neutralization activity against SARS-CoV-2 Wuhan D614G and B.1.351 variants by ACE2-740/Fab superheterodimers (Panel F of FIG. 52), Fab/Fab superheterodimers (Panel G of FIG. 52), and their parent antibodies as follows: (A) RG1 (REGN10987), RG1-ACE2 WT, RG1-ACE2 HA, RG1-RG1, (B) RG2 (REGN10933), RG2-ACE2 WT, RG2-ACE2 HA, RG2-RG2, (C) LY1 (LY-CoV555), LY1-ACE2 WT, LY1-ACE2 HA, LY1-LY1, (D) LY2 (LY-CoV016), LY2-ACE2 WT, LY2-ACE2 HA, LY2-LY2, (E) VR1 (VIR-7831), VR1-ACE2 WT, VR1-ACE2 HA, VR1-VR1, (F) CT1 (CT-P59), CT1-ACE2 WT, CT1-ACE2 HA, CT1-CT1. Abbreviations: ACE2 WT, ACE2 with wild-type angiotensin-converting activity; ACE2 HA, ACE2 with H378A mutation which abrogates angiotensin-converting activity.

To determine the utility of superdimerization to increase the potency of therapeutic antibodies, ACE2-740/Fab superheterodimers (Panel F of FIG. 52), Fab/Fab superheterodimers (Panel G of FIG. 52), and bispecific Fab1/Fab2 superheterodimers (Panel H of FIG. 52) were created using eight clinically authorized antibodies (13-18). In stoichiometric competition binding experiments with individual spike trimers, a preferred order-of-binding was observed in which antibody superheterodimer-spike complexes generally formed at the expense of parent antibody-spike complexes (FIGS. 62-63). Pseudovirus experiments similarly demonstrate a dramatic increase in the neutralization potency of antibody superheterodimers compared to their parent antibodies (FIG. 64). In particular, RG2-RG2 and CT1-CT1 neutralized the B.1.531 variant approximately 100-fold better than the REGN10933 and CT-P59 parent antibodies (FIG. 88).

It is noteworthy that ACE2 dimers, whether formed by CLD dimerization, Fc dimerization, or both, appear to bind with relatively low avidity to individual spike trimers, in spite of the trivalency of the spike protein, suggesting that the configuration of the three receptor binding domains (RBDs) is incompatible with bivalent binding by ACE2 dimers. The fact that ACE2 superdimers as well as antibody superdimers bind more strongly to individual spike trimers suggests that the topology of the superdimer allows it to assume a configuration that is capable of an intra-spike interaction in which at least two binding sites on the spike trimer are simultaneously engaged. The molar masses of superdimer-spike binding complexes formed in the presence of excess superdimer (FIG. 89) provide evidence for two distinct types of intra-spike interaction. The first type, exemplified by ACE2-740/615 superheterodimer and most of the Fab/Fab superheterodimers, is characterized by 1:1 superdimer-spike trimer complex, indicating an intra-spike, intersubunit interaction in which a single superdimer simultaneously engages a single type of epitope on at least two of the three S protein subunits constituting the spike trimer. The second type, exemplified by ACE2-740/B13A superheterodimer and bispecific Fab1/Fab2 superheterodimers, is characterized by a 2:1 or greater complex, indicating an intra-spike interaction in which each superdimer engages two distinct epitopes in an inter-subunit or intra-subunit fashion, but which in either event allows two or more superdimers to access an individual spike trimer simultaneously. The superdimer configuration may provide a general solution to the inability of antibodies and Fc-fusion proteins to engage multiple targets that are refractory to simultaneous binding, whether of a monospecific or multispecific nature.

Figure 65:
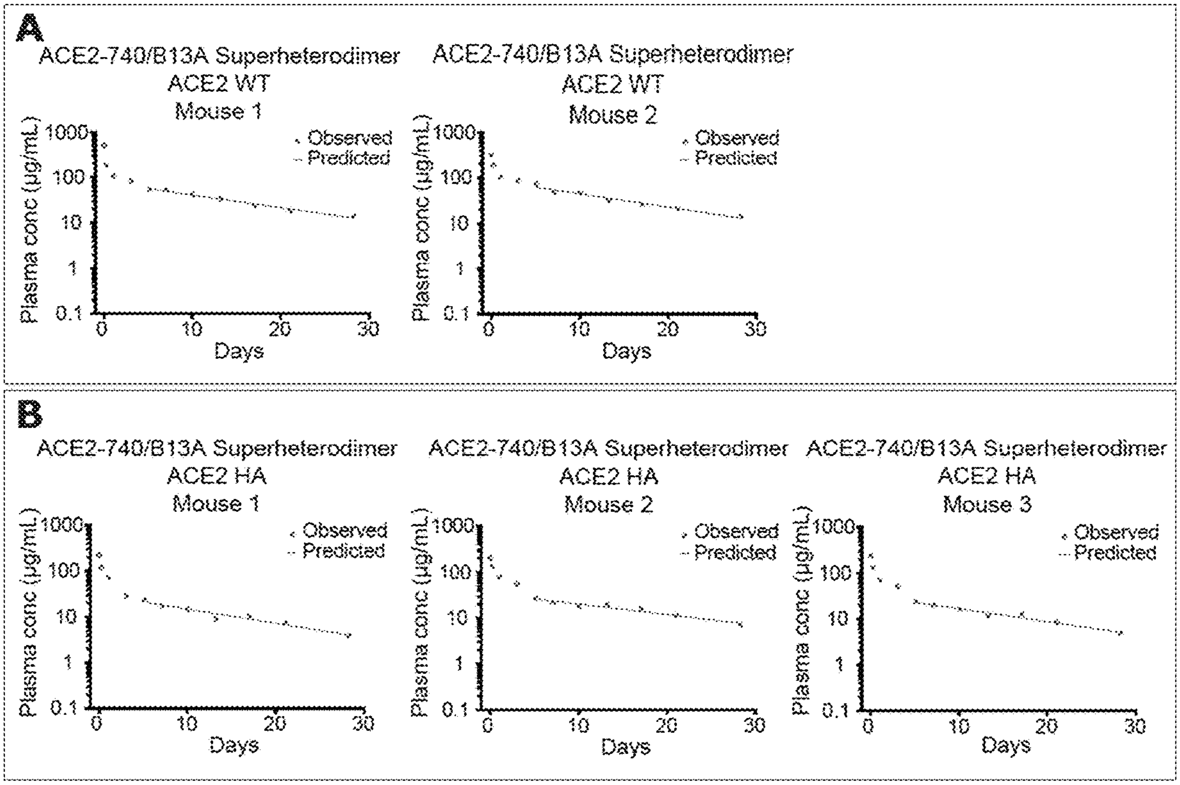
FIG. 65: Pharmacokinetics of ACE2-740/B13A superheterodimers in Tg32 mice. Time course of plasma concentration following a single intravenous administration in Tg32 mice (10 mg/kg) is shown for (A) ACE2-740/B13 superheterodimer (ACE2 WT), and (B) ACE2-740/B13 HA superheterodimer (ACE2 HA). Plasma concentration was determined by capture with SARS-CoV-2 spike protein and detection with anti-Fab antibody. Comparable results were obtained using anti-ACE2 antibody for detection. Profiles are shown for individual mice. Abbreviations: ACE2 WT, ACE2 with wild-type angiotensin-converting activity; ACE2 HA, ACE2 with H378A mutation which abrogates angiotensin-converting activity.
Figure 66:
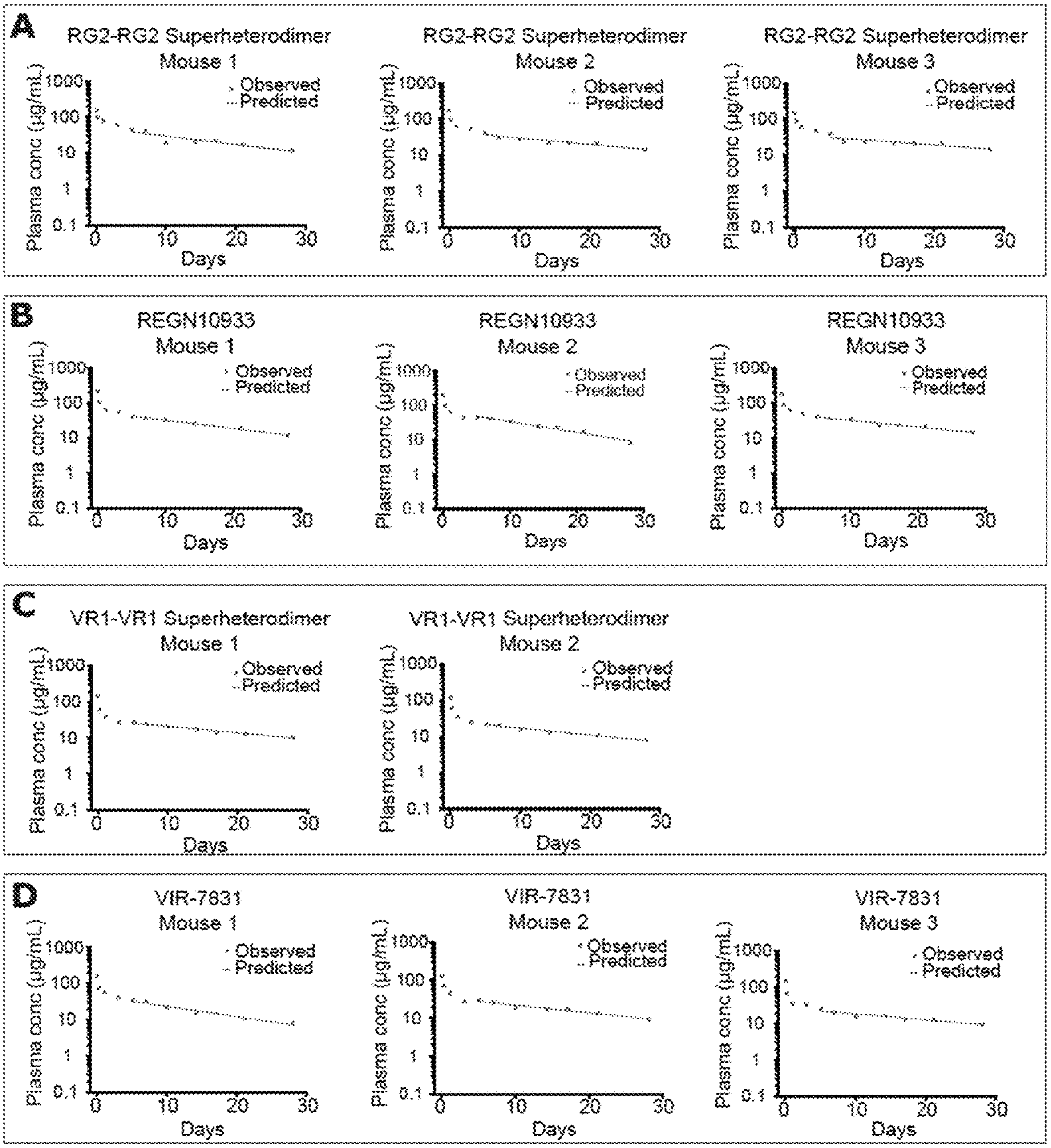
FIG. 66: Pharmacokinetics of GEM-DIMERs (Fab/Fab superheterodimers) in Tg32 mice compared to their parent antibodies. Time course of plasma concentration following a single intravenous administration in Tg32 mice (10 mg/kg) is shown for (A) RG2-RG2 superheterodimer, (B) REGN10933 (RG2) antibody, (C) VR1-VR1 superheterodimer, (D) VIR-7831 (VR1) antibody. Plasma concentration was determined by capture with SARS-Cov-2 spike protein and detection with anti-Fab antibody. Profiles are shown for individual mice.
Figure 67:
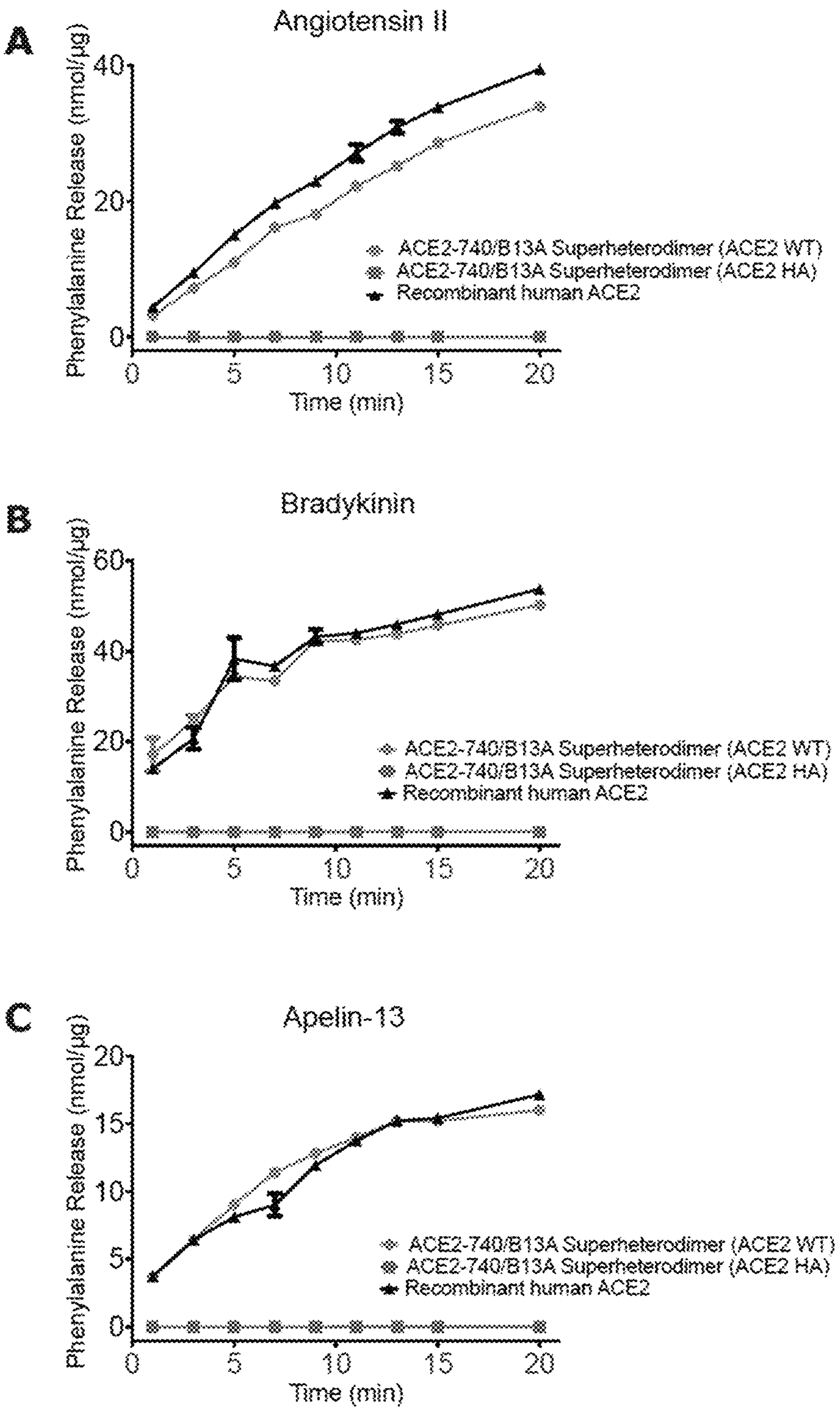
FIG. 67: Enzymatic activity of ACE2-740/B13A superheterodimers with wild-type and H378A mutant peptidase domains. Time course of phenylalanine release by wild-type ACE2-740/B13A superheterodimer (circles), H378A mutant ACE2-740/B13A superheterodimer (squares), and recombinant human ACE2 (triangles) are shown with the following substrates: (A) angiotensin II, (B) bradykinin, and (C) apelin-13.
Figure 68:
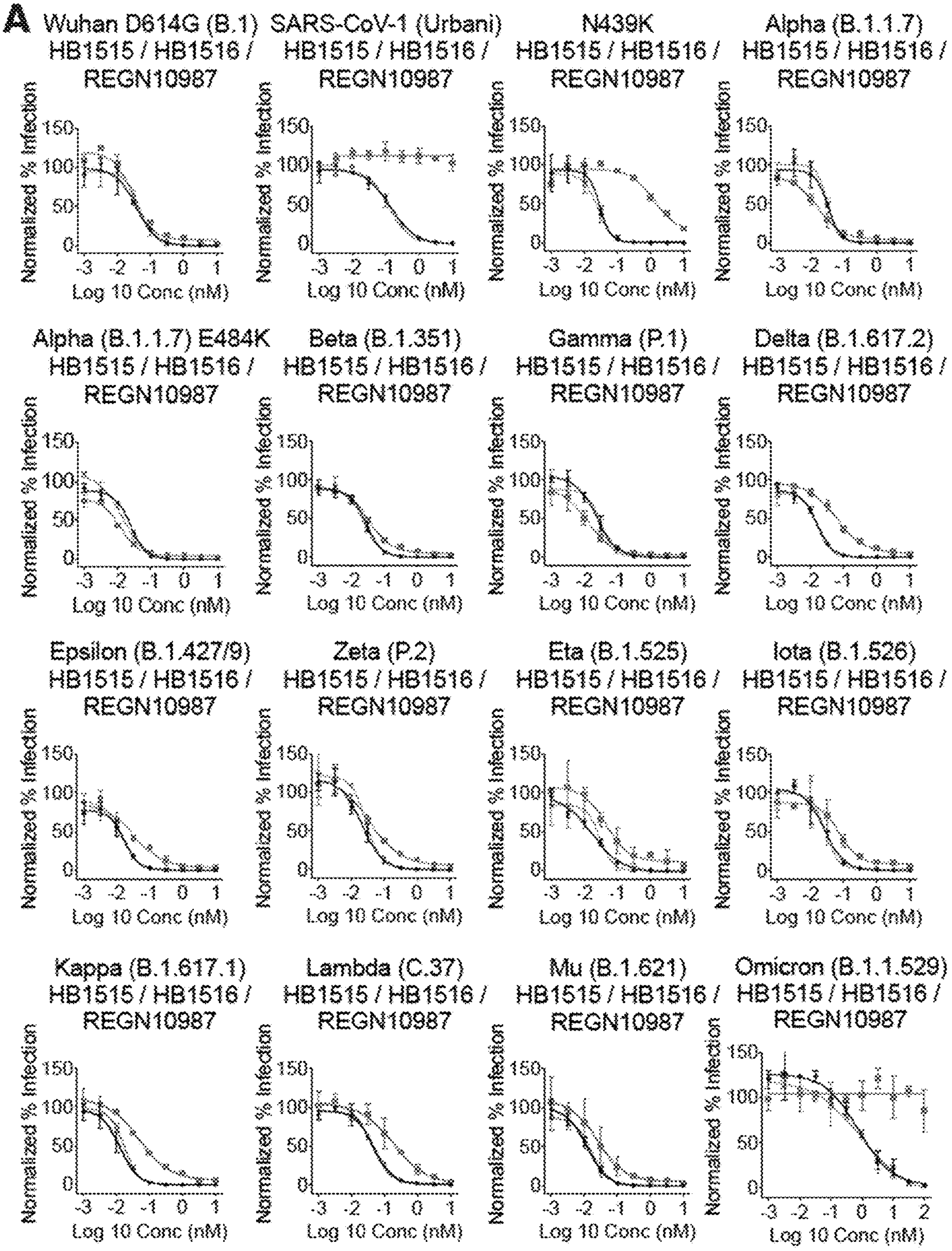
FIG. 68: Pseudovirus neutralizing activity of ACE2-740/615 superheterodimers (HB1507, HB1553) and ACE2-740/B13A superheterodimers (HB1515, HB1516) compared with eight clinically authorized antibodies against twelve major SARS-CoV-2 variants. Neutralization activity of the HB1515 (diamonds) and HB1516 (circles) ACE2-740/B13A superheterodimers (Panel F of FIG. 52) is compared with REGN10987 anti-spike antibody (squares). Results for twelve major SARS-CoV-2 variants are shown: Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529. Results are also shown for SARS-CoV-2 variants Wuhan D614G, N439K, and Alpha B.1.1.7 E484K, and the SARS-CoV-1 Urbani variant. The HB1515, HB1516, HB1507, and HB1553 ACE2-740/B13A superheterodimers have the ACE2 H378A mutation which abrogates angiotensin-converting activity. HB1515 and HB1553 have wild-type Fc receptor binding activity; HB1516 and HB1507 have the L234A, L235A mutations which abrogate Fc receptor binding activity.
Figure 69:
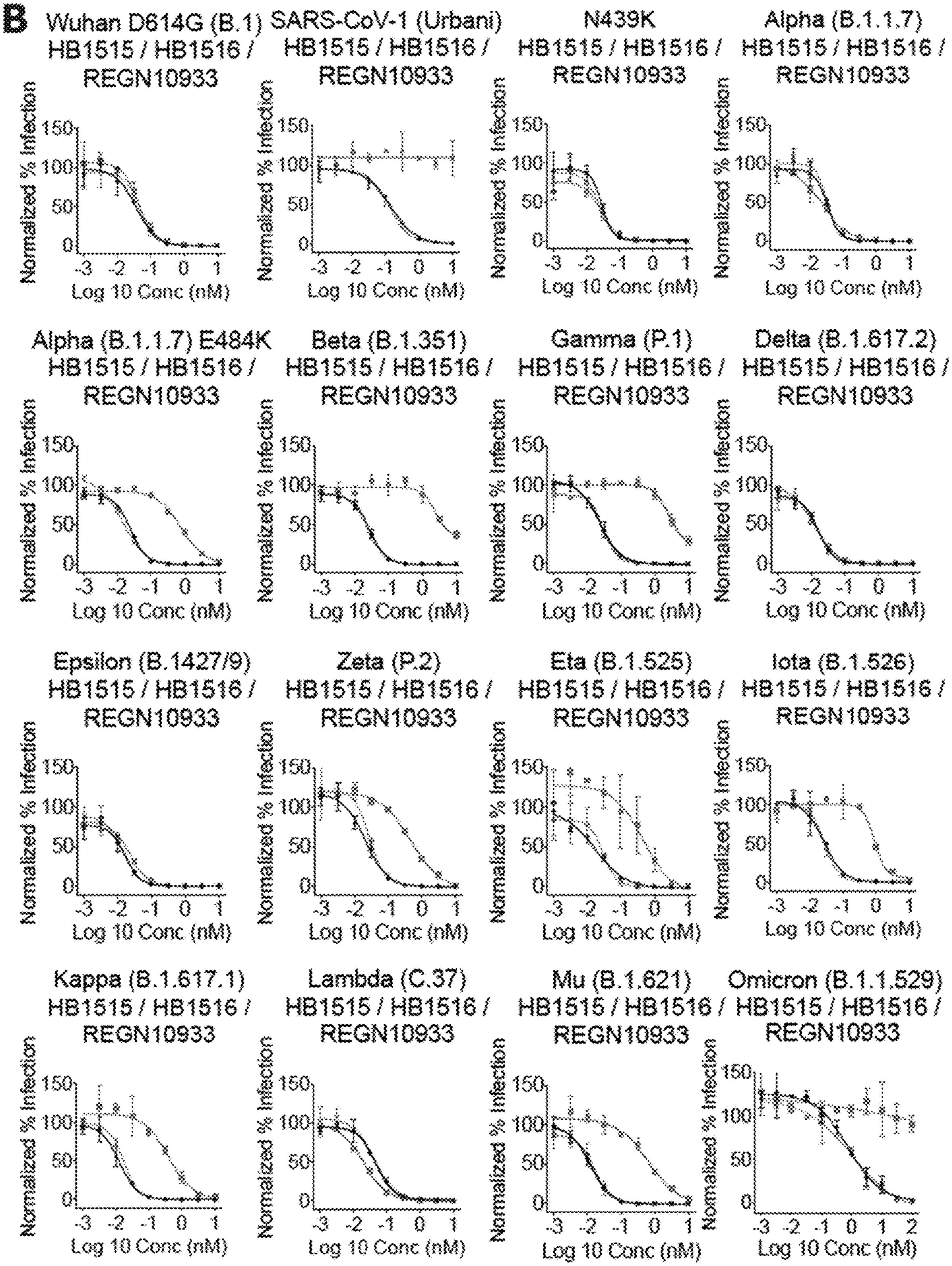
FIG. 69: Pseudovirus neutralizing activity of ACE2-740/615 superheterodimers (HB1507, HB1553) and ACE2-740/B13A superheterodimers (HB1515, HB1516) compared with eight clinically authorized antibodies against twelve major SARS-CoV-2 variants. Neutralization activity of the HB1515 (diamonds) and HB1516 (circles) ACE2-740/B13A superheterodimers (Panel F of FIG. 52) is compared with REGN10933 anti-spike antibody (squares). Results for twelve major SARS-CoV-2 variants are shown: Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529. Results are also shown for SARS-CoV-2 variants Wuhan D614G, N439K, and Alpha B.1.1.7 E484K, and the SARS-CoV-1 Urbani variant. The HB1515, HB1516, HB1507, and HB1553 ACE2-740/B13A superheterodimers have the ACE2 H378A mutation which abrogates angiotensin-converting activity. HB1515 and HB1553 have wild-type Fc receptor binding activity; HB1516 and HB1507 have the L234A, L235A mutations which abrogate Fc receptor binding activity.
Figure 70:
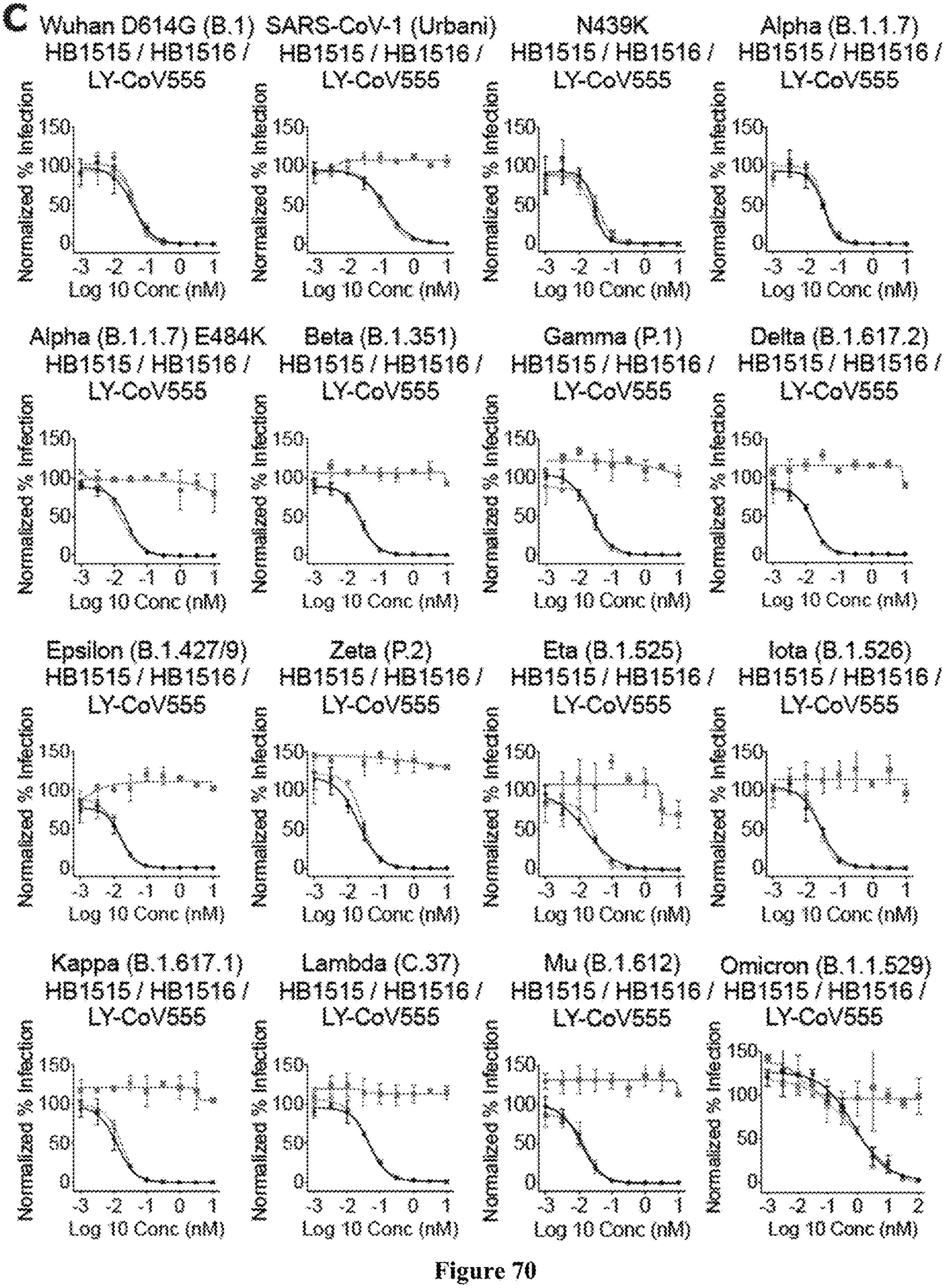
FIG. 70: Pseudovirus neutralizing activity of ACE2-740/615 superheterodimers (HB1507, HB1553) and ACE2-740/B13A superheterodimers (HB1515, HB1516) compared with eight clinically authorized antibodies against twelve major SARS-CoV-2 variants. Neutralization activity of the HB1515 (diamonds) and HB1516 (circles) ACE2-740/B13A superheterodimers (Panel F of FIG. 52) is compared with LY-CoV555 anti-spike antibody (squares). Results for twelve major SARS-CoV-2 variants are shown: Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529. Results are also shown for SARS-CoV-2 variants Wuhan D614G, N439K, and Alpha B.1.1.7 E484K, and the SARS-CoV-1 Urbani variant. The HB1515, HB1516, HB1507, and HB1553 ACE2-740/B13A superheterodimers have the ACE2 H378A mutation which abrogates angiotensin-converting activity. HB1515 and HB1553 have wild-type Fc receptor binding activity; HB1516 and HB1507 have the L234A, L235A mutations which abrogate Fc receptor binding activity.
Figure 71:
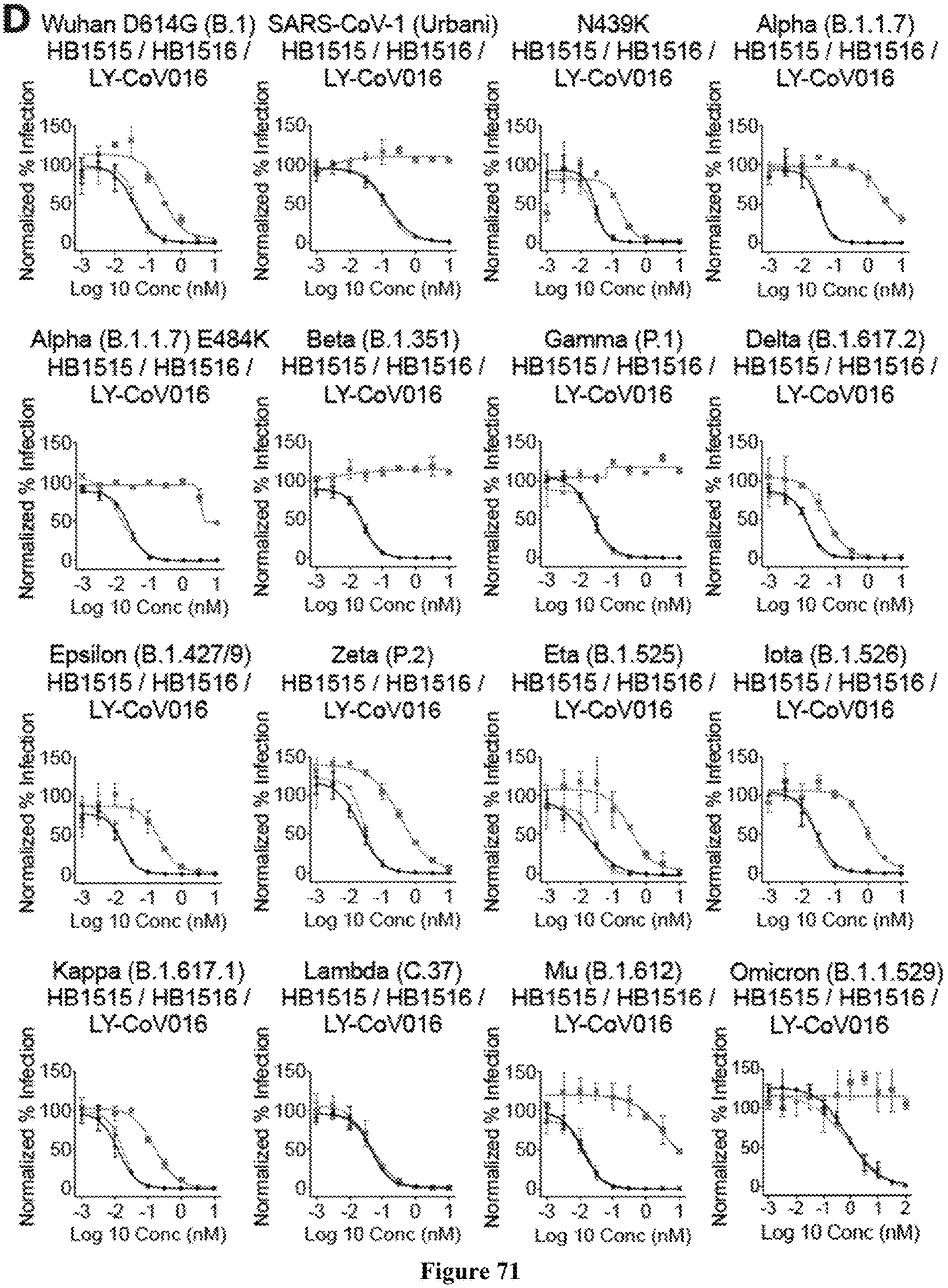
FIG. 71: Pseudovirus neutralizing activity of ACE2-740/615 superheterodimers (HB1507, HB1553) and ACE2-740/B13A superheterodimers (HB1515, HB1516) compared with eight clinically authorized antibodies against twelve major SARS-CoV-2 variants. Neutralization activity of the HB1515 (diamonds) and HB1516 (circles) ACE2-740/B13A superheterodimers (Panel F of FIG. 52) is compared with LY-CoV016 anti-spike antibody (squares). Results for twelve major SARS-CoV-2 variants are shown: Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529. Results are also shown for SARS-CoV-2 variants Wuhan D614G, N439K, and Alpha B.1.1.7 E484K, and the SARS-CoV-1 Urbani variant. The HB1515, HB1516, HB1507, and HB1553 ACE2-740/B13A superheterodimers have the ACE2 H378A mutation which abrogates angiotensin-converting activity. HB1515 and HB1553 have wild-type Fc receptor binding activity; HB1516 and HB1507 have the L234A, L235A mutations which abrogate Fc receptor binding activity.
Figure 72:
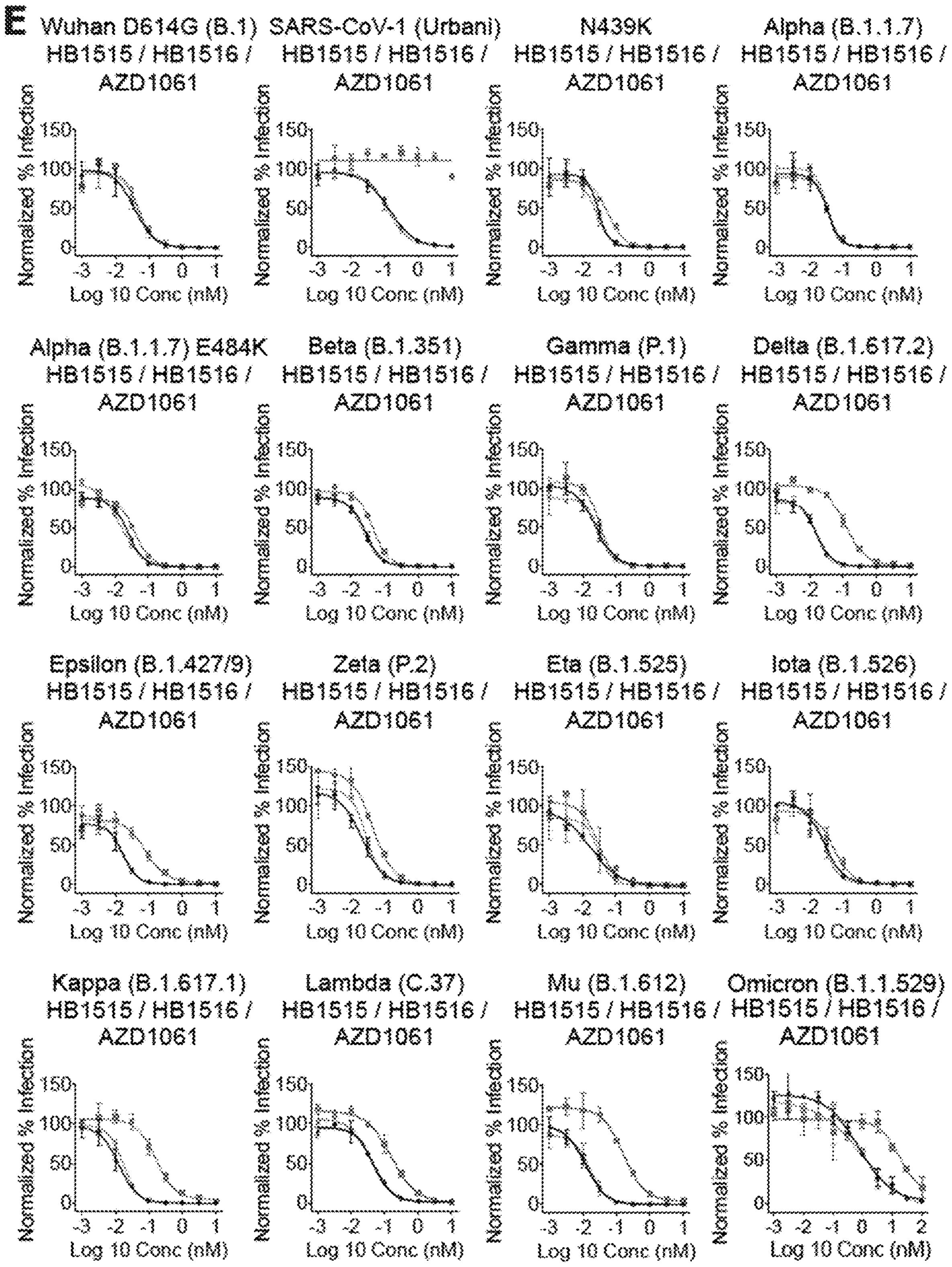
FIG. 72: Pseudovirus neutralizing activity of ACE2-740/615 superheterodimers (HB1507, HB1553) and ACE2-740/B13A superheterodimers (HB1515, HB1516) compared with eight clinically authorized antibodies against twelve major SARS-CoV-2 variants. Neutralization activity of the HB1515 (diamonds) and HB1516 (circles) ACE2-740/B13A superheterodimers (Panel F of FIG. 52) is compared with AZD1061 anti-spike antibody (squares). The neutralizing activity of ACE2-740/615 superheterodimers (Panel E of FIG. 52) is shown in (J) HB1507 (squares), and (K) HB1553 (squares). Results for twelve major SARS-CoV-2 variants are shown: Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529. Results are also shown for SARS-CoV-2 variants Wuhan D614G, N439K, and Alpha B.1.1.7 E484K, and the SARS-CoV-1 Urbani variant. The HB1515, HB1516, HB1507, and HB1553 ACE2-740/B13A superheterodimers have the ACE2 H378A mutation which abrogates angiotensin-converting activity. HB1515 and HB1553 have wild-type Fc receptor binding activity; HB1516 and HB1507 have the L234A, L235A mutations which abrogate Fc receptor binding activity.
Figure 73:
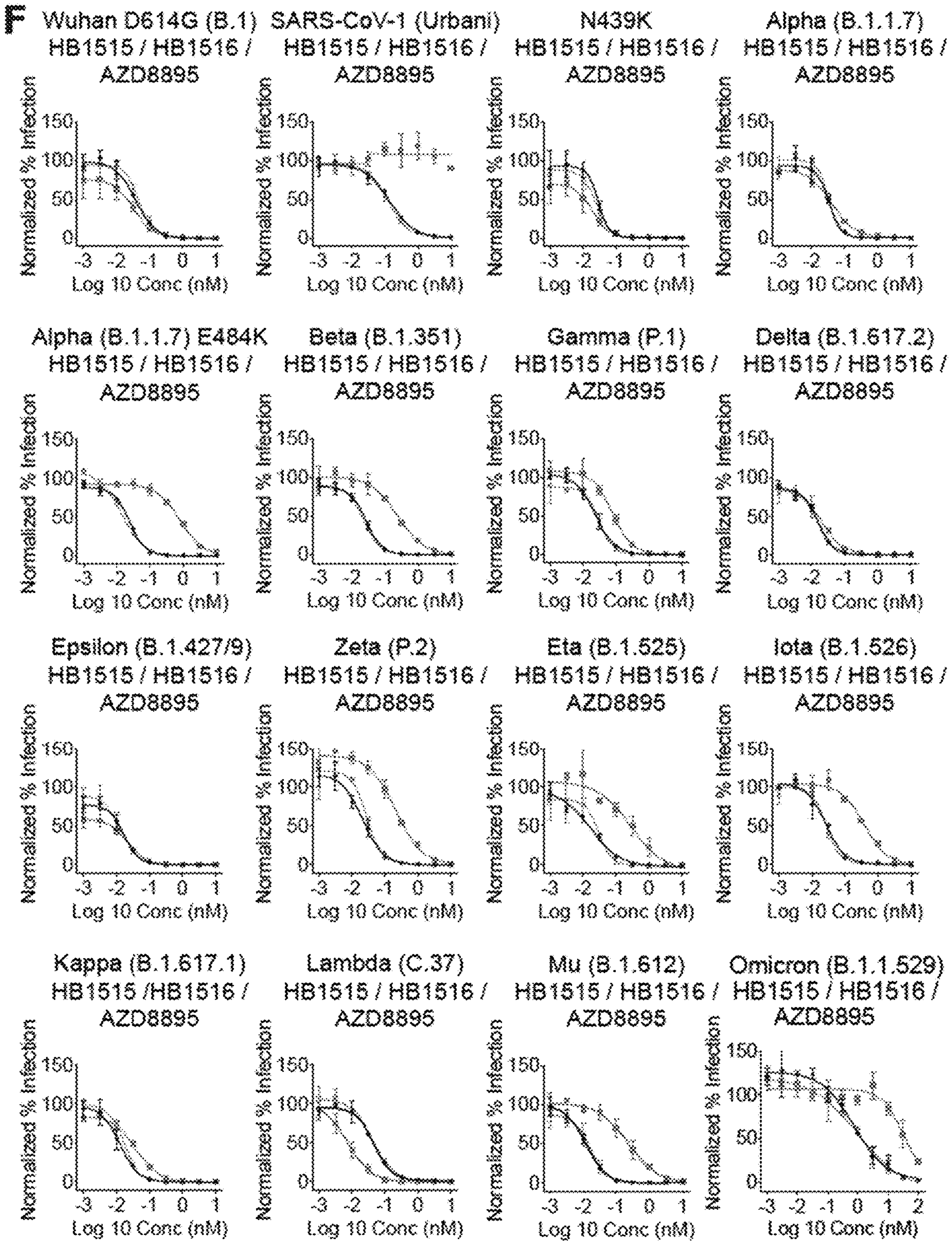
FIG. 73: Pseudovirus neutralizing activity of ACE2-740/615 superheterodimers (HB1507, HB1553) and ACE2-740/B13A superheterodimers (HB1515, HB1516) compared with eight clinically authorized antibodies against twelve major SARS-CoV-2 variants. Neutralization activity of the HB1515 (diamonds) and HB1516 (circles) ACE2-740/B13A superheterodimers (Panel F of FIG. 52) is compared with AZD8895 anti-spike antibody (squares). Results for twelve major SARS-CoV-2 variants are shown: Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529. Results are also shown for SARS-CoV-2 variants Wuhan D614G, N439K, and Alpha B.1.1.7 E484K, and the SARS-CoV-1 Urbani variant. The HB1515, HB1516, HB1507, and HB1553 ACE2-740/B13A superheterodimers have the ACE2 H378A mutation which abrogates angiotensin-converting activity. HB1515 and HB1553 have wild-type Fc receptor binding activity; HB1516 and HB1507 have the L234A, L235A mutations which abrogate Fc receptor binding activity.
Figure 74:
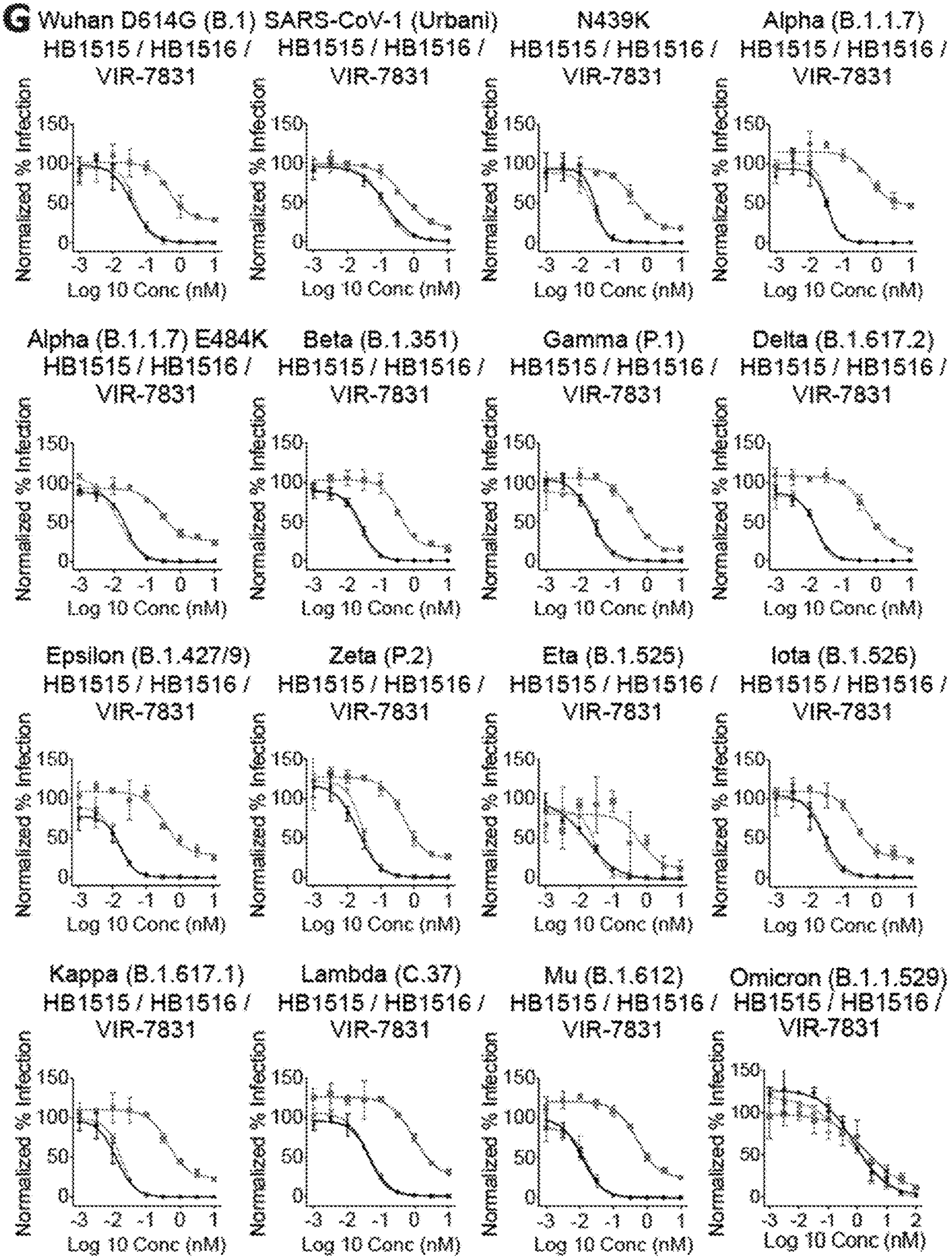
FIG. 74: Pseudovirus neutralizing activity of ACE2-740/615 superheterodimers (HB1507, HB1553) and ACE2-740/B13A superheterodimers (HB1515, HB1516) compared with eight clinically authorized antibodies against twelve major SARS-CoV-2 variants. Neutralization activity of the HB1515 (diamonds) and HB1516 (circles) ACE2-740/B13A superheterodimers (Panel F of FIG. 52) is compared with VIR-7831 anti-spike antibody (squares). Results for twelve major SARS-CoV-2 variants are shown: Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529. Results are also shown for SARS-CoV-2 variants Wuhan D614G, N439K, and Alpha B.1.1.7 E484K, and the SARS-CoV-1 Urbani variant. The HB1515, HB1516, HB1507, and HB1553 ACE2-740/B13A superheterodimers have the ACE2 H378A mutation which abrogates angiotensin-converting activity. HB1515 and HB1553 have wild-type Fc receptor binding activity; HB1516 and HB1507 have the L234A, L235A mutations which abrogate Fc receptor binding activity.
Figure 75:
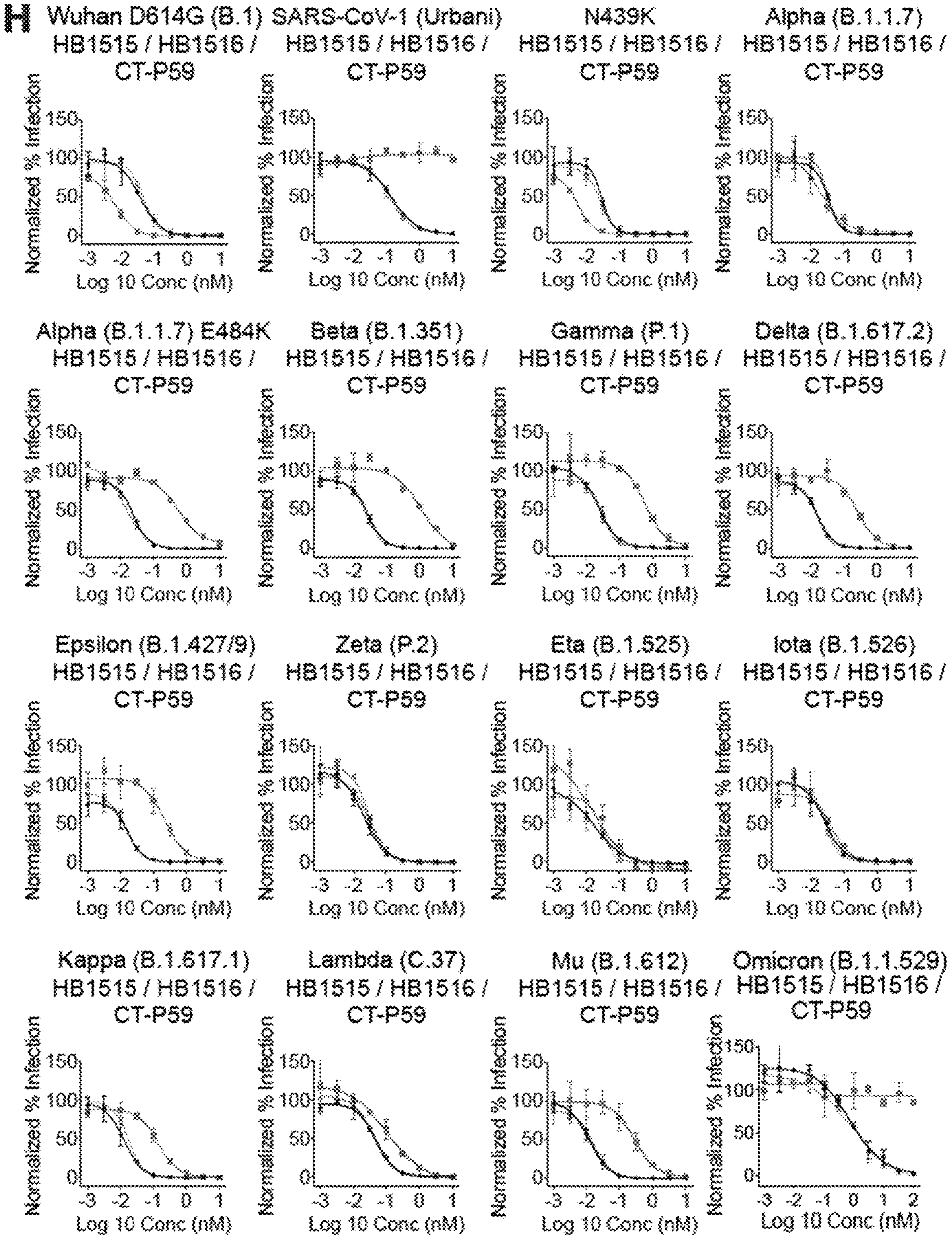
FIG. 75: Pseudovirus neutralizing activity of ACE2-740/615 superheterodimers (HB1507, HB1553) and ACE2-740/B13A superheterodimers (HB1515, HB1516) compared with eight clinically authorized antibodies against twelve major SARS-CoV-2 variants. Neutralization activity of the HB1515 (diamonds) and HB1516 (circles) ACE2-740/B13A superheterodimers (Panel F of FIG. 52) is compared with CT-P59 anti-spike antibody (squares). Results for twelve major SARS-CoV-2 variants are shown: Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529. Results are also shown for SARS-CoV-2 variants Wuhan D614G, N439K, and Alpha B.1.1.7 E484K, and the SARS-CoV-1 Urbani variant. The HB1515, HB1516, HB1507, and HB1553 ACE2-740/B13A superheterodimers have the ACE2 H378A mutation which abrogates angiotensin-converting activity. HB1515 and HB1553 have wild-type Fc receptor binding activity; HB1516 and HB1507 have the L234A, L235A mutations which abrogate Fc receptor binding activity.
Figure 76:
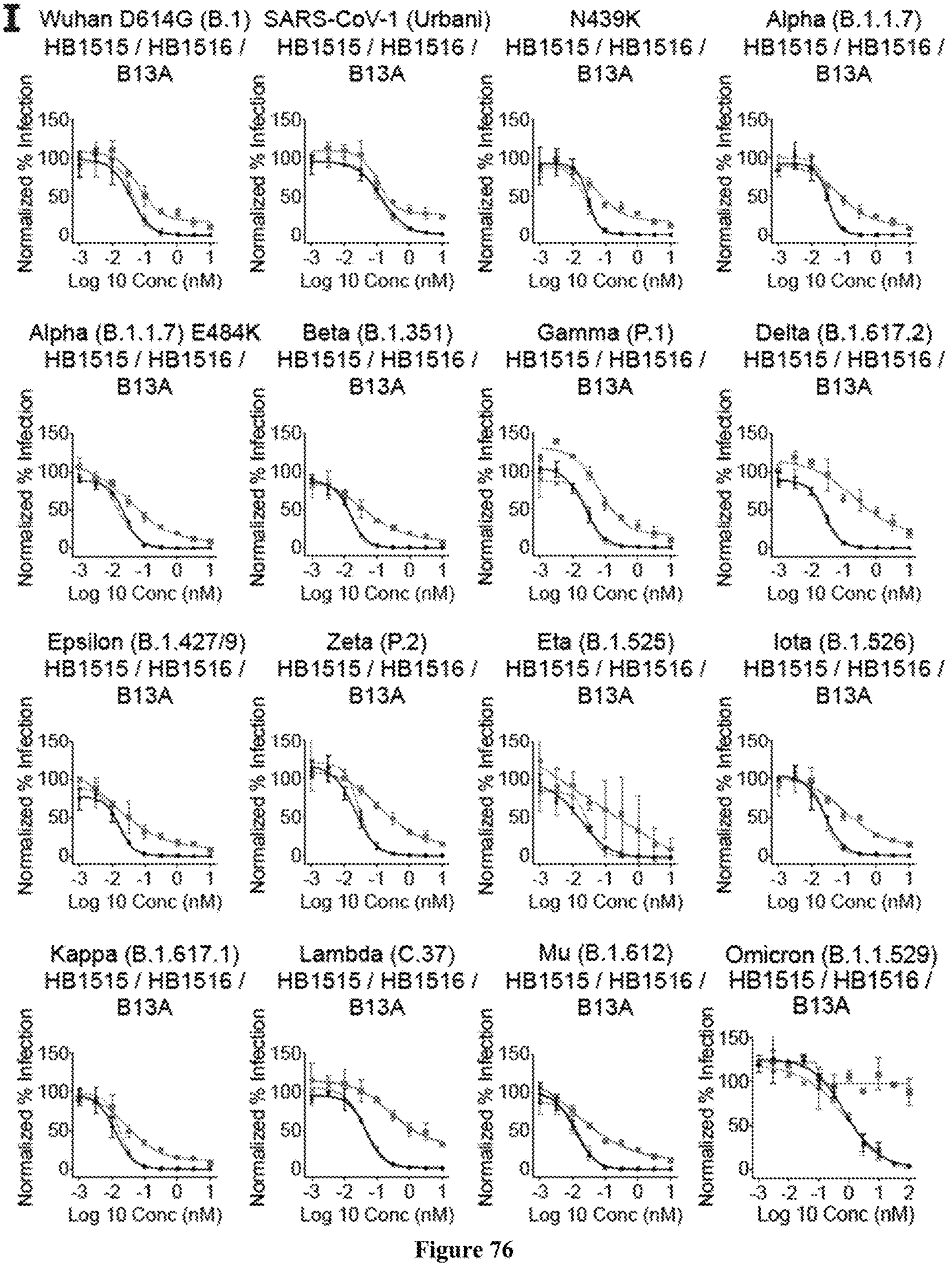
FIG. 76: Pseudovirus neutralizing activity of ACE2-740/615 superheterodimers (HB1507, HB1553) and ACE2-740/B13A superheterodimers (HB1515, HB1516) compared with eight clinically authorized antibodies against twelve major SARS-CoV-2 variants. Neutralization activity of the HB1515 (diamonds) and HB1516 (circles) ACE2-740/B13A superheterodimers (Panel F of FIG. 52) is compared with B13A anti-spike antibody (squares). Results for twelve major SARS-CoV-2 variants are shown: Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529. Results are also shown for SARS-CoV-2 variants Wuhan D614G, N439K, and Alpha B.1.1.7 E484K, and the SARS-CoV-1 Urbani variant. The HB1515, HB1516, HB1507, and HB1553 ACE2-740/B13A superheterodimers have the ACE2 H378A mutation which abrogates angiotensin-converting activity. HB1515 and HB1553 have wild-type Fc receptor binding activity; HB1516 and HB1507 have the L234A, L235A mutations which abrogate Fc receptor binding activity.
Figure 77:
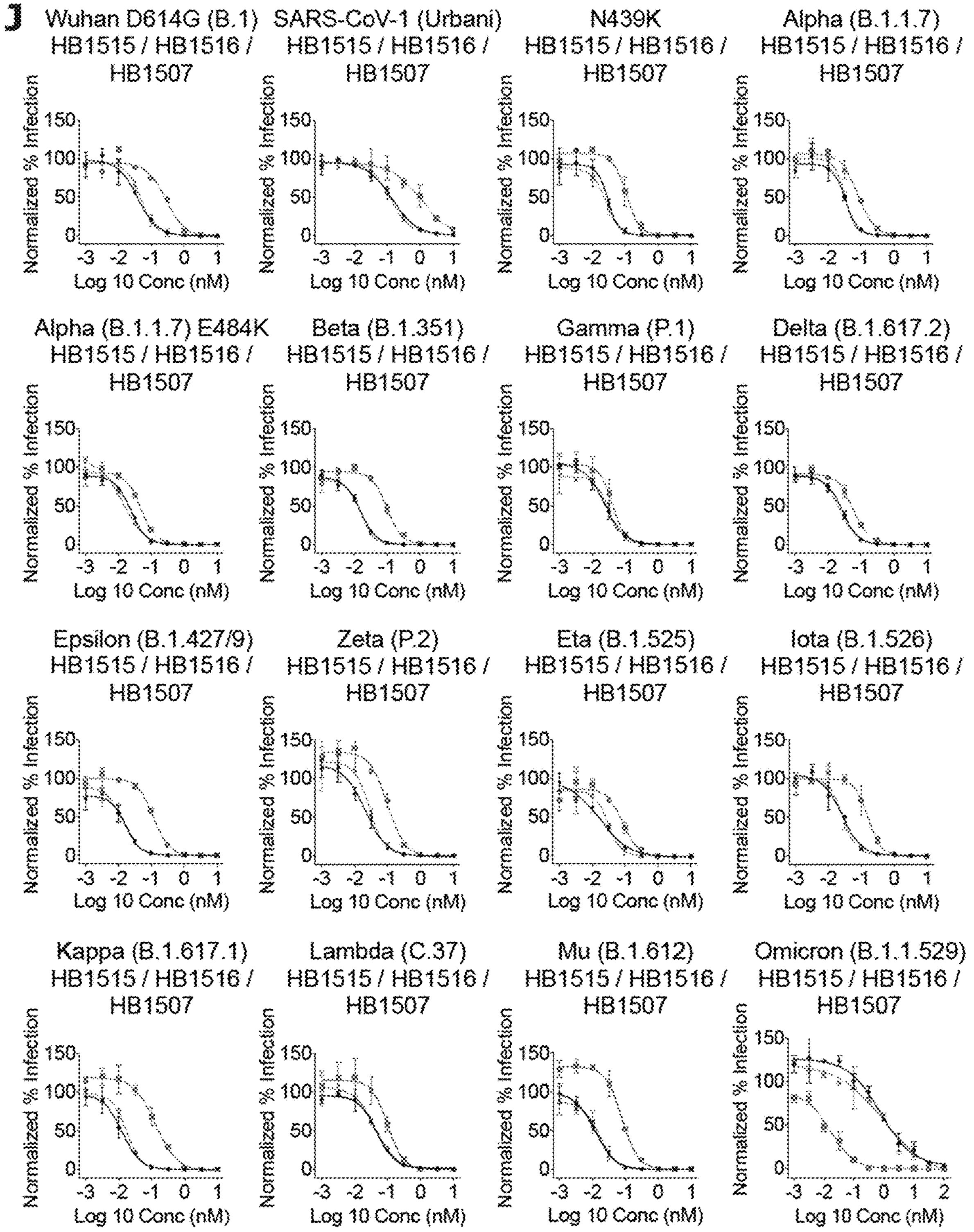
FIG. 77: Pseudovirus neutralizing activity of ACE2-740/615 superheterodimers (HB1507, HB1553) and ACE2-740/B13A superheterodimers (HB1515, HB1516) compared with eight clinically authorized antibodies against twelve major SARS-CoV-2 variants. Neutralization activity of the HB1515 (diamonds) and HB1516 (circles) ACE2-740/B13A superheterodimers (Panel F of FIG. 52) is compared with HB1507 ACE2-740/615 superheterodimer (squares) (Panel F of FIG. 52). Results for twelve major SARS-CoV-2 variants are shown: Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529. Results are also shown for SARS-CoV-2 variants Wuhan D614G, N439K, and Alpha B.1.1.7 E484K, and the SARS-CoV-1 Urbani variant. The HB1515, HB1516, HB1507, and HB1553 ACE2-740/B13A superheterodimers have the ACE2 H378A mutation which abrogates angiotensin-converting activity. HB1515 and HB1553 have wild-type Fc receptor binding activity; HB1516 and HB1507 have the L234A, L235A mutations which abrogate Fc receptor binding activity.
Figure 78:
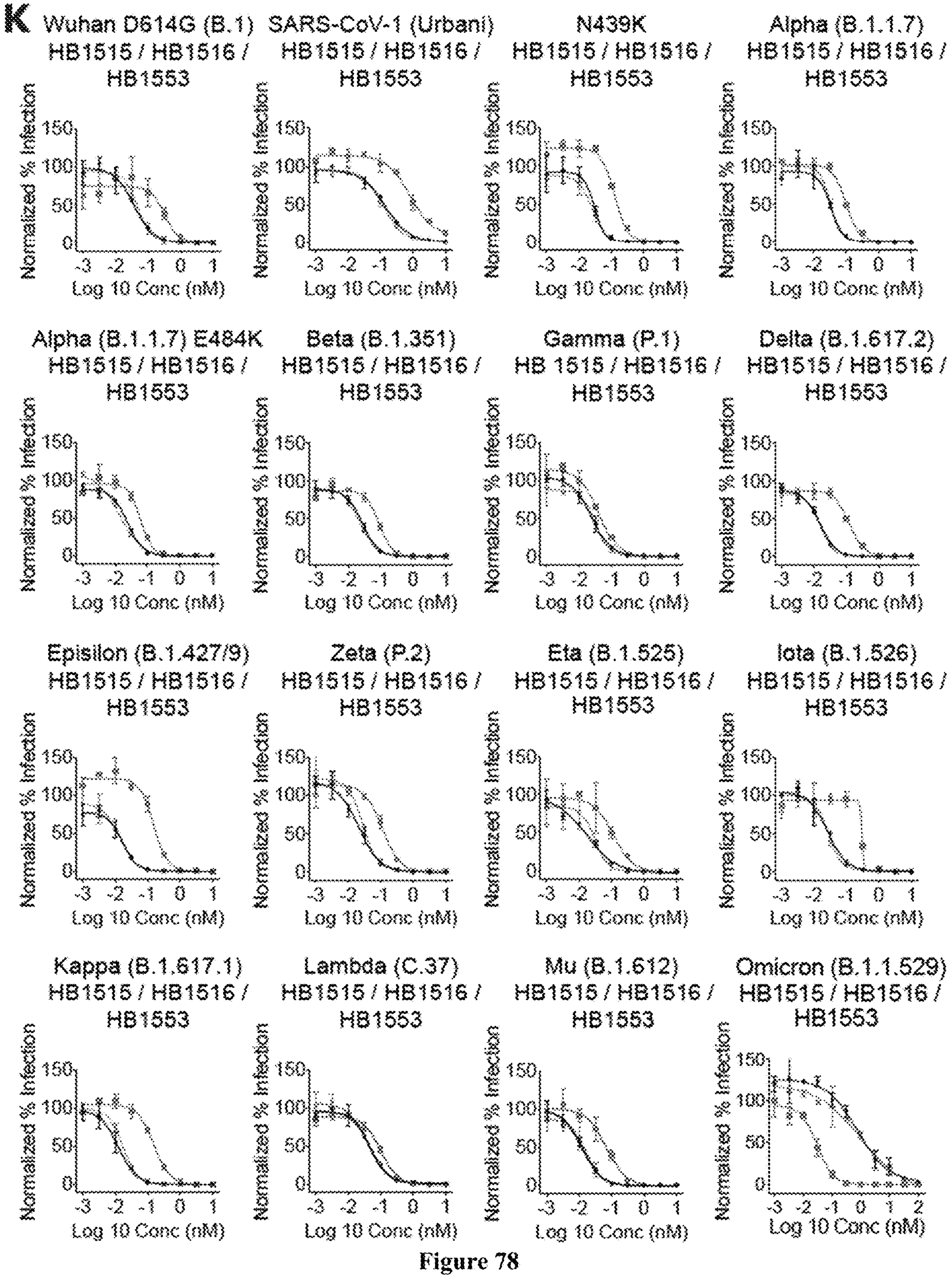
FIG. 78: Pseudovirus neutralizing activity of ACE2-740/615 superheterodimers (HB1507, HB1553) and ACE2-740/B13A superheterodimers (HB1515, HB1516) compared with eight clinically authorized antibodies against twelve major SARS-CoV-2 variants. Neutralization activity of the HB1515 (diamonds) and HB1516 (circles) ACE2-740/B13A superheterodimers (Panel F of FIG. 52) is compared with HB1553 ACE2-740/615 superheterodimer (squares) (Panel E of FIG. 52). Results for twelve major SARS-CoV-2 variants are shown: Alpha B.1.1.7, Beta B.1.351, Gamma P.1, Delta B.1.617.2, Epsilon B.1.427/B.1.429, Zeta P.2, Eta B.1.525, Iota B.1.526, Kappa B.1.617.1, Lambda C.37, Mu B.1.621, and Omicron B.1.1.529. Results are also shown for SARS-CoV-2 variants Wuhan D614G, N439K, and Alpha B.1.1.7 E484K, and the SARS-CoV-1 Urbani variant. The HB1515, HB1516, HB1507, and HB1553 ACE2-740/B13A superheterodimers have the ACE2 H378A mutation which abrogates angiotensin-converting activity. HB1515 and HB1553 have wild-type Fc receptor binding activity; HB1516 and HB1507 have the L234A, L235A mutations which abrogate Fc receptor binding activity.

It was next confirmed that superheterodimers have antibody-like plasma half-lives using the human FcRn Tg32 homozygous transgenic mouse model. This model is used to predict the clearance (CL) of human antibodies in humans with greater accuracy than non-human primate studies (19). Each superheterodimer was administered as a single i.v. bolus (10 mg/kg) and ACE2 plasma levels were determined by spike binding (FIGS. 65-66, FIG. 90). Two ACE2-740/B13A superheterodimers, one possessing and one lacking angiotensin-converting enzyme activity (FIG. 67, FIG. 91), demonstrate comparable terminal half-lives (T½) of 10.6 and 11.2 days, respectively, representing a 33.5- to 35.4-fold improvement compared with the T½ of 7.6 hours observed for soluble recombinant human ACE2 (APN01) in humans (single i.v. bolus at 1.2 mg/kg) (20). In addition, two GEM-DIMERs (Fab/Fab superheterodimers, Panel G of FIG. 52), RG2-RG2 and VR1-VR1, incorporating the Fab domains of the REGN10987 and VIR7831 antibodies, respectively, demonstrated a T½ of 17.6 and 16.3 days, respectively, which compared favorably with the T½ of 12.9 and 14.7 days observed for the parent antibodies.

The Omicron B.1.1.529 variant, which eliminates or substantially reduces the effectiveness of most clinically authorized antibodies, highlights a potential therapeutic advantage for ACE2 superdimers in addressing SARS-CoV-2 resistance. FIG. 3 demonstrates that both the ACE2-740/615 and ACE2-740/B13A superheterodimers potently neutralize viral infection by Omicron B.1.1.529 and eleven other major variants. ACE2-740/615 superheterodimer is extraordinarily effective against Omicron B.1.1.529 ($IC_{50}$=7-16 pM), demonstrating 147-fold or greater potency than REGN10987, REGN10933, LY-CoV555, LY-CoV016, AZD1061, AZD8895, VIR-7831, and CT-P59 (FIG. 55, FIGS. 68-78, FIG. 92). ACE2-740/B13A superheterodimer generally demonstrates equal or better neutralization activity than the same eight antibodies against all twelve variants. In keeping with our prediction of the particular therapeutic value of ACE2 molecules without affinity-enhancing mutations, SARS-CoV-2 has not, to date, successfully evaded neutralization by our ACE2 superdimers. It is suggested that Omicron B.1.1.529, known for its high transmissibility, has been selected in a manner resulting in its particular susceptibility to ACE2-740/615 superheterodimer with its four ACE2 domains.

Figure 56:
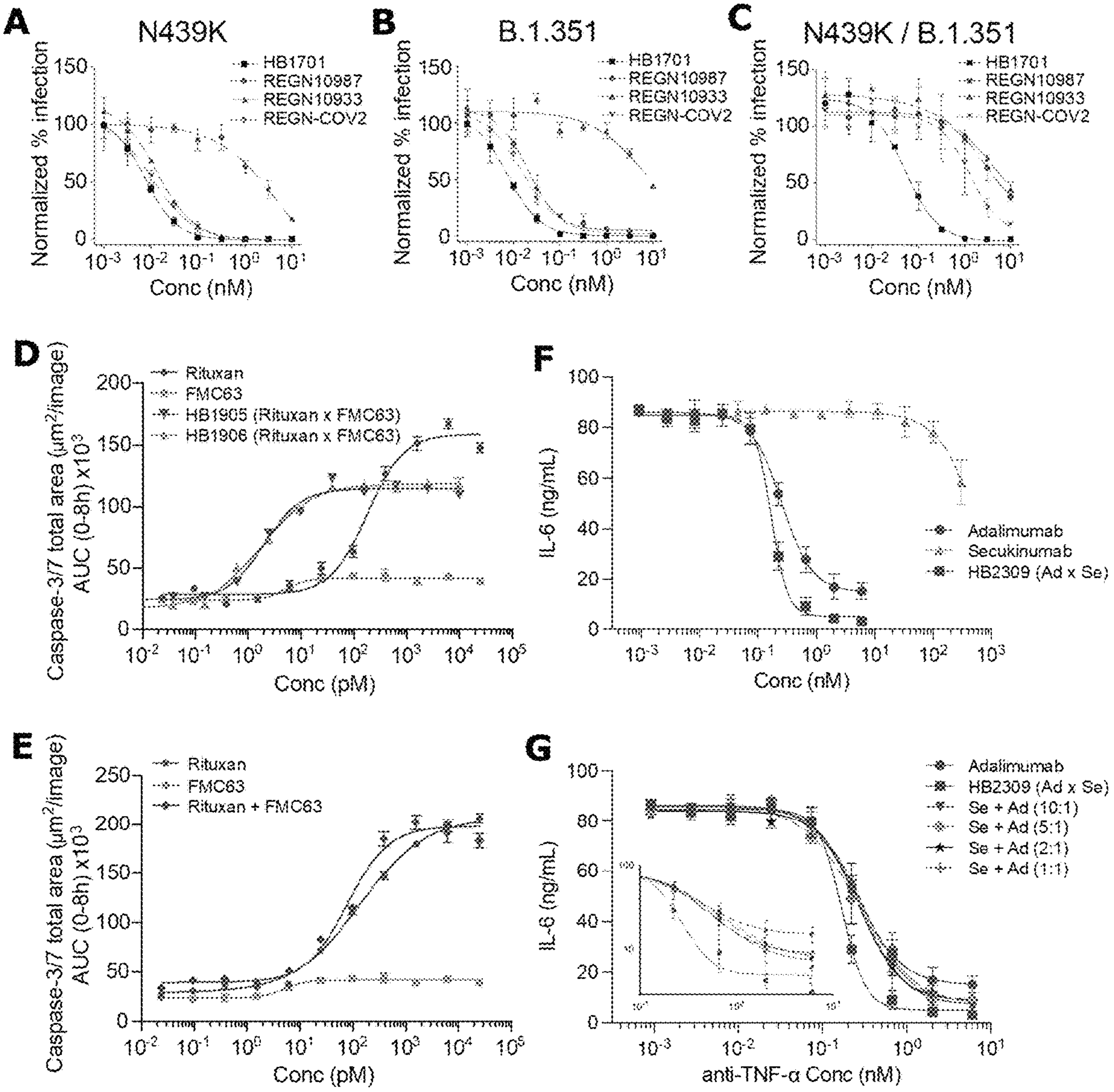
FIG. 56: Anti-viral, anti-cancer, and anti-inflammatory bispecific GEM-DIMERs (Fab1/Fab2 superheterodimers) are more potent than two-antibody cocktails. Panels A to C depict pseudovirus neutralization activity of bispecific ant-spike GEM-DIMER RG1-RG2 (HB1701; Protein ID 17-01) compared to its parent antibodies REGN10987 (RG1) and REGN10933 (RG2) used individually or as a two-antibody cocktail (REGN-COV2) against the (A) N439K variant, (B) B.1.351 variant, and (C) N439K/B.1.351 double variant. Panels D to E depicts kinetic activation of caspase-3/7 via ADCC in co-cultures of Toledo cells and human NK cells that have been treated with (D) bispecific anti-CD20×anti-CD19 GEM-DIMERs (HB1905, Protein ID 19-05, HB1906, Protein ID 19-06) compared to the Rituxan and FMC63 parent antibodies; and (E) a two-antibody cocktail of Rituxan and FMC63 compared to the Rituxan and FMC63 parent antibodies. Panels F to G depict neutralization of TNF-α/IL-17A induction of IL-6 secretion by normal human dermal fibroblasts (NHDF) by (F) the Ad x Se GEM-DIMER (HB2309; Protein ID 23-09), compared to the secukinumab and adalimumab parent antibodies; and (G), the HB2309 Ad x Se GEM-DIMER compared to adalimumab and several two-antibody cocktails consisting of the secukinumab and adalimumab parent antibodies at ratios of 1:1, 2:1, 5:1, and 10:1. In Panel (G) the x-axis reflects the concentration of the anti-TNF-α Fab portion that is present in the HB2309 Ad x Se GEM-DIMER, the adalimumab control, and in each of the two-antibody cocktails. The inset shows an expanded view of the dose response plotted in log-log scale.
Figure 79:
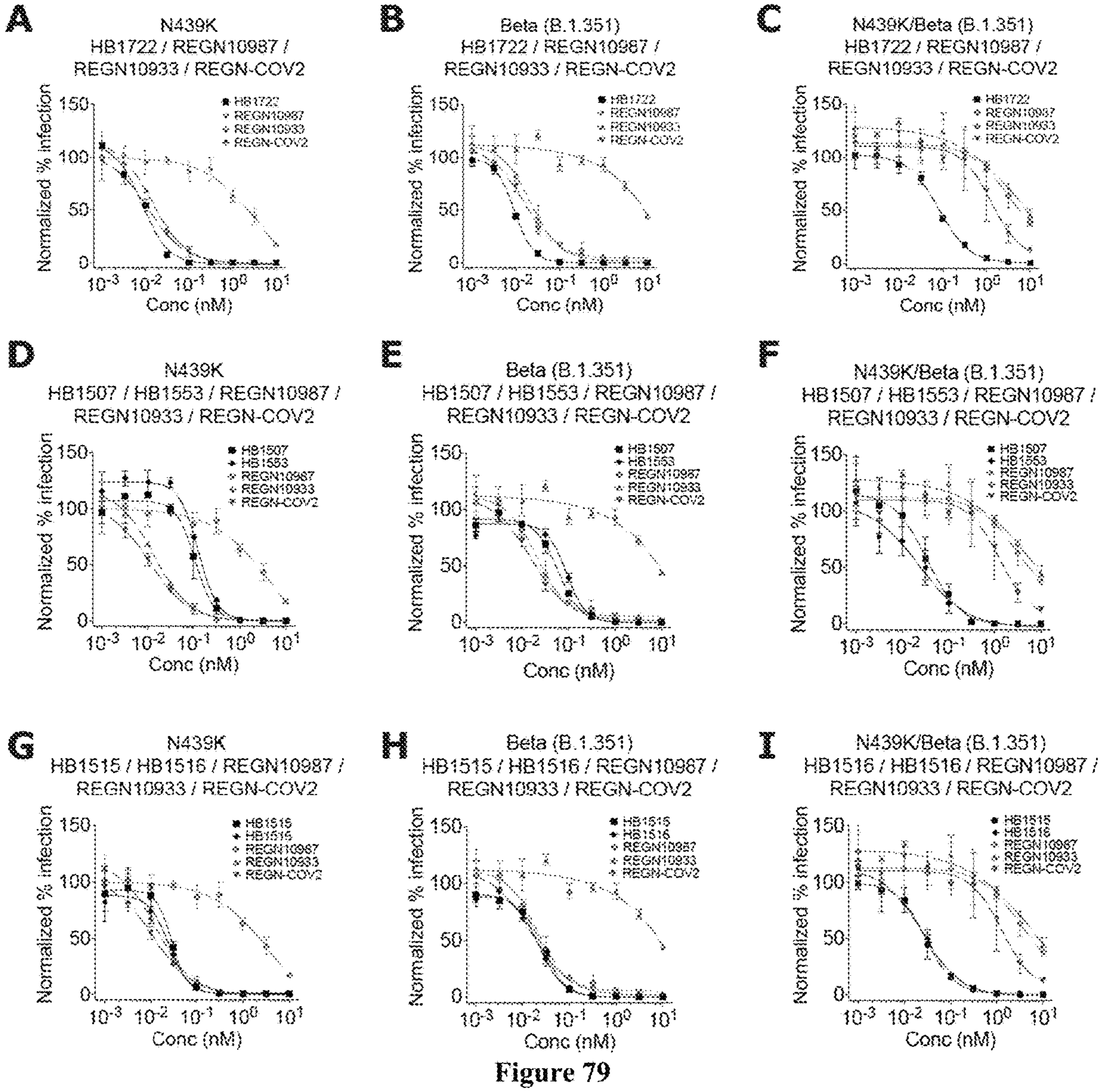
FIG. 79: Pseudovirus neutralizing activity of bispecific GEM-DIMERs (Fab1/Fab2 superheterodimers) compared with two-antibody cocktails of their parent antibodies. Pseudovirus neutralization activity of: (Panels A to C)

Bispecific GEM-DIMERs were created using two anti-spike antibodies to determine whether they can neutralize certain resistant variants more effectively than two-antibody cocktails containing the parent antibodies. A bispecific GEM-DIMER (Fab1/Fab2 superheterodimer, FIG. 52, Panel H) consisting of the REGN10987 and REGN10933 Fabs (HB1701; protein 17-01) neutralized the N439K/B.1.351 variant 25-fold better than a two-antibody cocktail of REGN10987 and REGN10933 (Panels A to C of FIG. 56, FIG. 79, FIG. 93). The neutralizing activity of HB1701 was comparable to the highly potent ACE2-740/615 and ACE2-740/B13A superheterodimers, demonstrating that bispecific GEM-DIMERs can potently neutralize SARS-CoV-2 variants that are resistant to cocktails of their parent antibodies.

It was next examined whether bispecific GEM-DIMERs can effectively target cell surface proteins, in particular targets for cancer therapeutics. The clinical application of anti-CD20 and anti-CD19 antibodies is associated with treatment-resistant and/or recurrent disease (21, 22) suggesting the therapeutic value of a GEM-DIMER targeting CD20 and CD19 simultaneously. Bispecific GEM-DIMERs were created (Fab1/Fab2 superheterodimers (Panel H of FIG. 52) using Rituxan, an anti-CD20 antibody widely used as a frontline treatment in B cell lymphoma (23), and FMC63, an anti-CD19 antibody used as a component of chimeric antigen receptors for CAR-T cell therapy of relapsed/refractory B-cell lymphoma (24). The ability of two anti-CD20/anti-CD19 bispecific GEM-DIMERs (HB1905, HB1906) to bind cell surface CD20 and CD19 was evaluated by pre-incubating each with the CD20/CD19-positive human Toledo cell line followed by addition of fluorescently labeled Rituxan and FMC63. FIG. 80 demonstrates that both HB1905 and HB1906 completely extinguish binding of both labeled antibodies, whereas the unlabeled Rituxan and FMC63 parent antibody controls each only compete against its labeled counterpart. Surface plasmon resonance binding studies demonstrate that HB1905 and HB1906 bind monovalent CD20 and CD19, as well as Fc gamma receptors and complement component C1q, with an affinity comparable to Rituxan and FMC63 (FIG. 81). The functional bispecificity of HB1905 and HB1906 was evaluated by antibody-dependent cell-mediated cytotoxicity (ADCC) of Toledo cells. As shown in Panels D to E of FIG. 56, the ADCC activity observed for HB1905 and HB1906 was 39- to 44-fold better than a two-antibody cocktail containing Rituxan and FMC63 (FIG. 94). These results indicate that the bispecific GEM-DIMER configuration may be generally valuable in anti-cancer therapeutics to combat resistance.

It was also examined whether bispecific GEM-DIMERs can effectively target soluble proteins, in particular cytokines that are important mediators of autoimmunity and inflammatory disease. Bispecific GEM-DIMERs (Fab1/Fab2 superheterodimers, Panel H of FIG. 52) were created using adalimumab, an anti-TNF-α antibody, and secukinumab, an anti-IL-17A antibody, which are used to treat rheumatoid arthritis, psoriatic arthritis, plaque psoriasis, ankylosing spondylitis, and inflammatory bowel disease (25). Two alternative GEM-DIMER configurations were evaluated, in which either the Fab derived from adalimumab or secukinumab is connected to the collectrin-like domain while the other Fab is connected directly to the Fc domain. GEM-DIMERs of both configurations (Ad x Se and Se x Ad) neutralized TNF-α with a potency comparably to adalimumab (Panel A of FIG. 82, FIG. 95). Remarkably, GEM-DIMERs of the Ad x Se configuration neutralized IL-17A with a potency 8.3-fold to 11.5-fold better than GEM-DIMERs of the Se x Ad configuration, and 9.1-fold to 12.0-fold better than secukinumab itself (Panel B of FIG. 82, FIG. 95). Next, the Ad x Se GEM-DIMER was evaluated for its ability to inhibit the synergistic effect of TNF-α and IL-17A on the production of IL-6 in normal human dermal fibroblasts. TNF-α and IL-17A together stimulate much higher levels of IL-6 in these cells than that observed with either TNF-α and IL-17A alone (FIG. 83). As shown in Panel F of FIG. 56, the HB2309 Ad x Se GEM-DIMER completely abolished the production of IL-6 induced by the TNF-α and IL-17A combination, while neither adalimumab nor secukinumab alone was able to do so. In addition, the Ad x Se GEM-DIMER was able to completely abolish the IL-6 response an order-of-magnitude more effectively than several two-antibody cocktails of secukinumab and adalimumab ranging from 1:1 to 50:1 (Panel G of FIG. 56).

In summary, this Example demonstrates that it is possible to create a new class of multispecific, multivalent, antibody-like molecules in the form of GEM-DIMERs that may be applied to any combination of antibodies and Fc-fusion proteins. It has been shown, using several model systems, namely neutralization of resistant virus, cancer cell killing, and cytokine inhibition, that GEM-DIMERs have activity superior to two-antibody cocktails in each of these three clinical areas. Their ease of synthesis, antibody-like pharmacokinetics and effector functions demonstrate that these molecules can be useful in a variety of clinical settings especially when combination therapy is warranted.

Supplemental Materials

Methods and Materials

Mammalian Expression and Purification of Recombinant Proteins

Recombinant proteins were expressed by transient expression in CHO-K1 cells adapted to serum-free suspension culture (TunaCHO) using a mammalian expression vector and purified by Protein A affinity chromatography (LakePharma, San Carlos, CA). Cells were seeded in a shake flask and expanded in suspension using a serum-free and chemically defined medium. On the day of transfection, cells were seeded into a new vessel with fresh medium. Transient transfections were performed by adding transfection reagents complexed with DNA under high density conditions. After transfection, cells were maintained as a batch-fed culture in a shake flask until the end of the production run. The conditioned cell culture fluid was harvested after 7 to 14 days, clarified by centrifugation, and sterile filtered prior to purification. Affinity chromatography was carried out by applying the supernatant to a column packed with the CaptivA Protein A Affinity Resin (Repligen, Massachusetts, USA) pre-equilibrated with phosphate buffered saline (PBS) (137 mM NaCl, 2.7 mM KCl, 10 mM $Na_2HPO_4$, 2 mM $KH_2PO_4$ pH 7.4). The column was washed with PBS until the $OD_{280}$ value returned to baseline. Target protein was then eluted with 0.25% acetic acid at pH 3.5. Fractions were collected, buffered with 1 M HEPES, and fractions containing the target protein were pooled, buffer exchanged into 100 mM HEPES, 100 mM NaCl, 50 mM sodium acetate, pH 6.0, filtered through a 0.2 μm membrane filter and stored at 4° C. prior to use. The protein concentration was calculated from the $OD_{280}$ value and calculated extinction coefficient.

Preparative Size-Exclusion Chromatography (SEC)

Preparative SEC was carried out on an AKTA Avant 25 (Cytiva, Marlborough, MA). Proteins were concentrated to 10-15 mg/mL using an Amicon Ultra-15, 3MWCO, ultracentrifugal filter unit, Cat #UFC900324 (Millipore, Burlington, MA), then loaded onto a HiLoad 26/600 Superdex 200 preparative grade column, Cat #28989336 (Cytiva, Marlborough, MA). Elution was carried out with PBS, Cat #CCFAL003 (UCSF Cell Culture Facility, San Francisco, CA). Fractions corresponding to the protein of interest were identified based upon analytical SEC and analysis by reducing and non-reducing SDS-PAGE, pooled, concentrated by ultrafiltration, and stored at 4° C.

Analytical Size-Exclusion-High-Performance Liquid Chromatography (SE-HPLC)

Analytical SE-HPLC was carried out on a Prominence HPLC (Shimadzu, Kyoto, Japan). Zenix-C SEC-300 columns (3μ particle size, 300 angstrom pore size, 4.6×300 mm), Cat #233300-4630 (Sepax, Newark, Delaware), were used as a pair in series with mobile phase (PBS, 300 mM NaCl), flow rate (0.2 mL/min), column temperature (25° C.), and detection wavelength (280/214 nm). LabSolutions v5.9 software (Shimadzu) was used for UV data acquisition and processing.

Multi-Angle Light Scattering (MALS) Analysis

The molar mass of proteins was determined by combining SE-HPLC with measurement of refractive index (RI) and multi-angle light scattering (SEC-MALS) using an Optilab T-rEX RI detector and Treos MALS detector in-line (Wyatt, Goleta, CA). The temperature of the detectors was maintained at 25° C. The signal obtained for the monomeric form of bovine serum albumin (BSA) was used to normalize the detectors and to correct for band broadening between detectors. Astra v6.1.7 software (Wyatt Technology) was used for light scattering and refractive index data acquisition and processing. A value of 0.185 mL/g was used for the dn/dc ratio of proteins.

IdeZ Cleavage Analysis and TCEP Reduction

Digestions were carried out with 100 μg of protein and 3 μL of IdeZ Protease, Cat #P0770S (NEB, Ipswich, MA), in a 100 μL reaction volume containing 1× GlycoBuffer 2 at 37° C. for 60 min. The reaction mixture was then mixed with 100 μL slurry of Protein A Sepharose Fast Flow beads, Cat #17507901 (Cytiva), for 1 hr at RT with constant mixing in a rotator. Fragments lacking the Fc domain were recovered by centrifugation at 1000×g for 2 min using 0.5 mL spin columns, Cat #69705 (Thermo Fisher, Waltham, MA). The beads were washed with 25 μL of PBS and the two eluates combined. One-half of the eluate was reduced with TCEP-HCl (tris (2-carboxyethyl) phosphine hydrochloride) Cat #20490 (Thermo Fisher), at 0.17 mM and incubated for 30 min in the dark at RT. IdeZ-treated and IdeZ-treated/TCEP-reduced aliquots were analyzed by SEC-MALS as described.

Stoichiometric Competition Binding Analysis

Binding reactions were prepared by titrating the spike-binding protein with aggregate-free, individual spike trimers (Wuhan-Hu-1, GenBank: MN908947, NCBI ref sequence NC_045512.2, Lot No. 20345PPT) (ExcellGene, Monthey, Switzerland) in PBS. Reactions were incubated at 14° C. for 3 hrs, then analyzed by SEC-MALS as described.

Kinetic Exclusion Assay (KinExA)

KinExA experiments were performed at RT (approx. 22° C.) on a KinExA 3200 (Sapidyne, Boise, ID). The spike-binding protein served as the constant binding partner ("CBP") and was titrated with spike trimer (ExcellGene) as the "titrant" in PBS with 1 mg/mL BSA, Cat #2A3018 (Sapidyne). Samples were equilibrated at RT and remaining free spike-binding protein was captured by filtration on solid phase polymethylacrylate (PMMA) particles, Cat #2P4510 (Sapidyne) or 98 μm polystyrene particles, Cat #442178 (Sapidyne) previously adsorption-coated with spike protein at a concentration of 30 μg/mL. A secondary antibody, Alexa Fluor 647-conjugated AffiniPure Goat Anti-Human IgG, $F(ab')_2$, Cat #109-605-097 or Affinipure Rabbit Anti-Human IgG Fcγ fragment specific, Cat #309-005-008 (Jackson ImmunoResearch, West Grove, PA), at a final concentration of 0.5 μg/mL was used to detect the unbound fraction.

KinExA detection optics consisted of a 620/30 bandpass excitation filter, a 670/40 bandpass emission filter and a 645 nm longpass dichroic mirror. Standard equilibrium analysis was performed using v4.3.20 of the KinExA Pro software (Sapidyne). Titrant and CBP concentrations used in the n-curve analysis were converted to binding site concentrations based on the indicated valence of test article provided in the tables. The spike trimer was used as the analysis concentration reference after correction for activity.

Neutralization of SARS-CoV-2 Spike Protein Binding to ACE2-Expressing Cells 293T-hsACE2 cells, Cat #C-HA101 (Integral Molecular, PA) were cultured in DMEM, Cat #30-2002 (ATCC, Manassas, VA) with 10% FBS, Cat #SH30910.03HI (Cytiva), 10 mM HEPES, 1× pen-strep, Cat #15140148 (Thermo Fisher), and 1 mg/mL puromycin, Cat #A1113802 (Thermo Fisher) in T75 culture flasks. On day 1, cells were trypsinized with 0.05% Trypsin-EDTA, Cat #25200056 (Thermo Fisher), washed with DMEM and placed in 96 well V-bottom plates at $5\times10^4$ cells/well. Serially diluted spike-binding proteins were added to cells in duplicate, incubated for 5 min at RT, followed by the addition of 2.5 nM biotinylated aggregate-free spike trimer (Excellgene) and incubated 1 hr at RT. Cells were washed twice with Wash Buffer (PBS, 1% BSA), Cat #130-091-376 (Miltenyi, Germany), resuspended in Wash Buffer with AF488-labeled Streptavidin, Cat #405235 (BioLegend, San Diego, CA), and incubated for one hr at 4° C. The cells were washed twice, resuspended in Wash Buffer, and analyzed on a NovoCyte 2000R cytometer (Agilent, Santa Clara, CA). The MFI of AF488 Streptavidin bound to biotinylated spike on the cell-surface was determined with NovoExpress Software v1.4.1 (Agilent) and results analyzed by nonlinear regression using GraphPad Prism v5. The amount of bound spike trimer in relative units (RU) was determined using a standard curve with known concentrations of the spike protein.

Live SARS-CoV-2 and NL63 Neutralization Assay

Infectious virus USA-WA1/2020, Cat #NR-52281, and NL63, Cat #NR-470 (BEI, Manassas, VA) was expanded using a single passage in Vero/TMPRSS2 cells. Virus was end-point titrated in Vero/TMPRSS2 and 100 $TCID_{50}$ used per well. Virus was pre-incubated for 1 hr at 37° C. with serial dilutions of antibody, then plated in replicates of 8 on Vero/TMPRSS2 cells. After 7 days, wells were scored for cytopathic effect.

Pseudotyped SARS-CoV-2 Neutralization Assay

Neutralization assays were carried out with pseudotyped SARS-CoV-2 reporter virus particles (RVPs) with luciferase from Integral Molecular according to their protocol with the following variants: D614G B.1 (RVP-702L), SARS-CoV-1 Urbani (RVP-801L), N439K (RVP-704L), Alpha UK B.1.1.7 (RVP-706L), UK B.1.1.7 with E484K (RVP-717L), Beta South African Δ3 B.1.351 (RVP-724L), South African B.1.351 (RVP-707L), Gamma Brazilian P.1 (RVP-708L), Delta Indian B.1.617.2 (RVP-763L), Epsilon Californian B.1.427/B.1.429 (RVP-713L), Zeta Brazilian P.2 (RVP-736L), Eta Nigerian/European B.1.525 (RVP-723L), Iota New York B.1.526 (RVP-726L), Kappa Indian B.1.617.1 (RVP-730L), Lambda C.37 (RVP-766L), Mu Columbia, B.1.621 (RVP-767L), Omicron B.1.1.529 (RVP-786L), and a variant incorporating the N439K and Beta South Africa Δ3 B.1.351 mutations (RVP-769L). Serially diluted anti-spike proteins were incubated with pseudotyped SARS-CoV-2 *Renilla* luciferase for 1 hr at 37° C. Nine or more concentrations were tested for each protein. Pseudovirus in culture media without protein was used as a negative control to determine 100% infectivity. The mixtures were then incubated with 293T-hsACE2 cells at $2.5\times10^5$ cells/mL in the 96-well plates. Infection took place over approximately 72 hrs at 37° C. with 5% $CO_2$. The luciferase signal was measured using the *Renilla*-Glo Luciferase Assay System, Cat #E2710 (Promega, Madison, WI) with the luminometer set at 1 ms integration time. The relative luminescence signals (RLU) obtained from the negative control wells were normalized and used to calculate the neutralization percentage for each concentration. All samples were run in duplicate. The data were processed by GraphPad Prism v9.3.1 to fit a 4-parameter logistic curve and calculate the log $IC_{50}$.

Syrian Hamster Efficacy Study

The study was conducted at BIOQUAL, Inc. (Rockville, MD). A total of 24 male golden hamsters 6-8 weeks old were assigned to four groups (n=6). Animals were treated with the appropriate material for their group on study day minus one (−1) via intraperitoneal (IP) injection. Test articles were prepared in PBS. The SARS-CoV-2 B.1.351 variant that was used for infection, hCoV-19/South Africa/KRISP-K005325/2020, Cat #NR-54974, Lot #020521-105) was sourced from BEI Resources (ATCC). This variant has the following amino acid mutations in its spike protein with reference to the sequence of the Wuhan-1 isolate (NCBI Reference Sequence: NC_045512.2): L18F, D80A, D215A, L242/A243/L244 deletion, K417N, E484K N501Y, D614G, A701V. On study day 0, animals were bled pre-challenge, followed by intranasal challenge with 108,750 PFU of SARS-CoV-2 in PBS 50 uL per nostril. Animals were observed twice daily in the post-challenge phase and their weights were collected daily.

Pharmacokinetic (PK) Assays

The study was conducted by The Jackson Laboratory, Bar Harbor, ME using 6-8 week old male B6.Cg-Fcgrttm1Dcr Tg(FCGRT)32Dcr/DcrJ mice homozygous for the human FcRn transgene. Initial body weights were measured within 1 day of each test article administration. At 0 hrs on Day 0, each protein was administered by IV injection at 10 mg/kg in a volume of 5 mL/kg. Blood samples (25 μL) were collected from each mouse at 5 min, 6 hr, 1 d, 3 d, 5 d, 7 d, 10 d, 14 d, 17 d, 21 d, and 28 d after administration. The blood samples were collected into 1 μL of K3EDTA, processed to plasma, diluted 1/10 in 50% glycerol in PBS, frozen in specialized 96 well storage pates and stored at −20° C. Plasma samples were assayed by the electrochemiluminescence immunoassay to detect the levels of each protein conducted at Hinge Bio Inc. Spike protein, Cat #46328 (LakePharma), was diluted to 20 nM with PBS and coated on QuickPlex 96-Well plates, Cat #L55XA, Meso Scale, Rockville, MD) with 25 μL per well. The plates were sealed and incubated overnight at 4° C., then blocked by PBS-B (PBS with 1% BSA) at RT for 30 min. Plasma samples were diluted 250- to 4000-fold with PBS-B and 25 μL of the diluted samples were added to the coated MSD plates using Biomek 15 liquid handler (Beckman, Brea, CA). Plasma samples were incubated with shaking (700 rpm) at RT for 60 mins. Biotinylated goat anti human-Fab antibody, Cat #ab64666 (Abcam, Cambridge, UK), or biotinylated goat Anti-Human ACE-2 antibody, Cat #DY933-05 (R&D Systems, Minneapolis, MN) was used as a detection antibody. Detection antibody (25 μL) was incubated with shaking (700 rpm) at RT for 60 mins. Sulfo-tag streptavidin (25 μL), Cat #R32AD (Meso Scale) was used as a secondary detection reagent. Read Buffer A (150 μL), Cat #R92TG (Meso Scale) was added before the plate was read on the MESO QuickPlex. Data were analyzed with MSD Discovery Workbench 4.0.13 (Meso Scale).

Pharmacokinetic (PK) Analysis

Noncompartmental pharmacokinetic data analysis was performed using Phoenix WinNonlin v8.3 (Certara, Princeton, NJ). Parameters were estimated for individual mice using a module for IV bolus administration. The area under the plasma concentration versus time curve was estimated using the linear trapezoid method. Terminal slopes for all animals were estimated over the time period from approximately 5 days through the end of sampling at approximately 28 days and used to calculate half-life and AUC extrapolated to infinity.

ACE2 Enzyme Assays

The carboxypeptidase reaction was initiated when 0.025 μg (wild-type) or 15 μg (ACE2 mutant) of protein was added to 0.2 μM angiotensin II, Cat #AS-20633 (AnaSpec, Fremont, CA), bradykinin, Cat #AS-65642 (AnaSpec) or apelin-13, Cat #APEL-003 (CPC Scientific, San Jose, CA) in the presence of the reaction buffer (PBS with 10 μM $ZnCl_2$) at 37° C. Recombinant human ACE2, Cat #79200 (BioLegend), was used as a positive control. Aliquots (25 μL) were taken every 2 min and heat inactivated at 80° C. for 5 min. The amount of phenylalanine in the heat inactivated aliquots was quantified using the phenylalanine assay kit, Cat #ab83376 (Abcam).

Cell Surface CD20, CD19 Binding Assays

Toledo cells, Cat #CRL-2631 (ATCC), were cultured in RPMI-1640, Cat #30-2001 (ATCC), with 10% fetal bovine serum (FBS) and 1 μg/mL gentamicin, Cat #15750060 (Thermo Fisher), in T25 culture flasks. Cells were dispensed in 96-well V-bottom plates at a concentration of $5\times10^4$ cells/well in Blocking Buffer (PBS with 5% mouse serum), Cat #M5905 (Millipore), and incubated with 100 nM CD20- and/or CD19-binding proteins for 30 min at room temperature. The Rituxan and FMC63 antibodies were labeled with AF488, Cat #ab236553, and AF647, Cat #ab269823 (Abcam), respectively, according to the manufacturer's instructions. Cells were incubated with 100 nM labeled antibodies for 30 min at room temperature, washed twice with Wash Buffer (PBS with 0.3% BSA), Cat #A7030 (Millipore), resuspended in Wash Buffer with propidium iodide, Cat #P3566 (Thermo Fisher), to distinguish live cells and analyzed using a NovoCyte 2000R cytometer and NovoExpress Software v1.4.1 (Agilent).

Antibody-Dependent Cellular Cytotoxicity (ADCC) Assay

Toledo cells were used as target cells and maintained in RPMI with GlutaMax, Cat #61870036 (Thermo Fisher Scientific, Waltham, MA), and 10% FBS, Cat #SH30070.03IH30-45 (Cytiva). To differentiate target cells from natural killer (NK) cells, the Toledo cells were labeled with 5 μM CellTrace Yellow, Cat #C34567 (Thermo Fisher), for 20 min at 37° C. After quenching and washing according to the manufacturer's recommendation, $1\times10^3$ cells, in duplicate, were incubated with CD20- and/or CD19-binding proteins and 2 μM CellEvent Caspase-3/7 Green Detection Reagent, Cat #C10423 (Thermo Fisher), for 10 min at room temperature in 96-well ultra-low attachment 96-well microplates, Cat #7007 (Corning, Corning, NY). Human peripheral blood NK cells, Cat #70036 (StemCell Technologies, Vancouver, Canada), were added at an effector: target ratio of 10:1. Caspase-3/7 cleavage was measured every hour for 8 hours using an IncuCyte SX5 (Sartorius, Göttingen, Germany), at 37° C. with 5% $CO_2$. Caspase-3/7 positive target cells were discriminated from unlabeled apoptotic NK cells using multi-channel fluorescence. Kinetic data were obtained using IncuCyte 2021A software (Sartorius) before area-under-the-curve (AUC) (mean±SEM) and non-linear regression analysis were performed using GraphPad Prism v9.3.1.

Surface Plasmon Resonance (SPR) Experiments

SPR capture kinetic experiments were performed on a Carterra LSA instrument (Carterra, Salt Lake City, UT). Recombinant proteins (5 μg/mL) were directly immobilized on the Carterra CMD-P chip using amine coupling. Recombinant FcγRIIIa (2000 nM-2.7 nM), Cat #4325-FC-50 (R&D Systems), FcγRIIa (R167) (667 nM-2.7 nM), Cat #1330-CD-050/CF (R&D Systems), FcγRI (55.6 nM-0.68 nM), Cat #CF1257-FC (R&D Systems), CD19 (500 nM-0.68 nM), Cat #CD9-H52H2 (ACROBiosystems, Newark, DE), C1q (167 nM-0.68 nM), Cat #A099 (Complement Technology, Tyler, Texas) were diluted in three-fold dilution steps using HEPES buffer (10 mM HEPES, 150 mM NaCl, 3 mM EDTA, with 0.005% Tween-20, 0.05% DDM, 0.01% CHS pH 7.4 with 0.05 mg/ml BSA). Recombinant CD20 (167 nM-0.68 nM), Cat #CD0-H52H3 (ACROBiosystems), was diluted in a three-fold dilution step with HEPES buffer containing 0.05% DDM and 0.01% CHS. Proteins were injected onto the CMD-P chip for 5 min during the association phase followed by HEPES buffer injection for another 5 min during the dissociation phase. The CMD-P chip was regenerated by flowing Pierce IgG Elution Buffer, Cat #21004 (Thermo Fisher), with 1 M NaCl, 3 times with 1 min intervals after each round of analyte injection. Data were analyzed using the Carterra Kinetics Software (Carterra).

Inhibition of Recombinant Human TNF-α-Mediated Cytotoxicity on WEHI-164 Cells

Neutralizing potency of HB2309, HB2310, HB2313, and HB2314 was measured in a recombinant human rhTNF-α-induced cytotoxicity assay in a WEHI-164 mouse fibrosarcoma cell line expressing endogenous mouse TNF-α receptors. WEHI-164 cells, Cat #CRL1751 (ATCC, Manassas, VA), were seeded in duplicate at $5\times10^4$ cells/well into a 96-well plate and cultured in RPMI 1640 medium supplemented with 10% (v/v) FBS for 18 hours. Serially diluted GEM-DIMERs and antibodies (final concentration: 10.2-60,000 pM) were preincubated in medium containing 2 μg/mL actinomycin D and 20 IU/mL of human TNF-α for 30 min at 37° C. The cells were incubated for an additional 20 h at 37° C. and cell viability was analyzed using CellTiter-Glo, Cat #G7573 (Promega, Madison, WI), according to the manufacturer's recommendations.

IL-17A Reporter Bioassay

Neutralizing potency of HB2309, HB2310, HB2313, and HB2314 was measured with the IL-17 Bioassay Thaw and Use kit, Cat #CS2018C08 (Promega, WI), following the manufacturer's recommendations. Briefly, proprietary cells supplied with the kit containing a luciferase reporter gene driven by the IL-17R promoter were cultured for 18 hours at 37° C. with 5% $CO_2$. Serially diluted GEM-DIMERs and antibodies were preincubated with 20 ng/mL recombinant human IL-17A, Cat #200-17 (PeproTech EC Ltd, Rocky Hill, NJ), for 25 min at 37° C. before being added to the cells. The cells were incubated for an additional 6 hours at 37° C. with 5% $CO_2$. IL-17A activity was quantitated by measuring luminescence with SpectraMax® Paradigm® (Molecular Devices, LLC, San Jose, CA). Nonlinear regression was performed with Prism v9.5.0.

Neutralization of Recombinant Human IL-17A and TNF-α-Induced IL-6 Secretion from Normal Human Dermal Fibroblasts Primary normal human dermal fibroblasts NHDF, Cat #12302 (PromoCell, Heidelberg, Germany), isolated from the dermis of adult skin were cultivated in Growth Medium 2, Cat #C23020 (PromoCell), and plated overnight in 96-well plates, Cat #6005182 (Perkin Elmer, Waltham, MA), at $2\times10^4$ cells per well. Media was replaced the following day with media containing a previously established synergistic combination of 2.5 ng/mL recombinant human TNF-α, (Cat #10291), and 10 ng/ml recombinant human IL-17A, Cat #7955 (R&D Systems, Minneapolis, MN), that was preincubated with serially diluted GEM-DIMER (HB2309), adalimumab, secukinumab, or various ratios of secukinumab to adalimumab for 30 min at 37° C. After 24 hours, supernatants were collected and used to determine the concentration of secreted IL-6, Cat #K151AKB-2 (Mesoscale Discovery, Rockville, MD), according to the manufacturer's instructions.

Discussion

The ability of antibodies and Fc-fusion proteins to bind multiple targets cooperatively is often limited by their topology. This Example reports the discovery that ACE2-Fc fusion proteins spontaneously cross-dimerize, forming "superdimers" capable of extraordinary SARS-CoV-2 intra-spike cooperative binding and neutralization of all major viral variants including Omicron. This Example demonstrate how super-dimerization of antibodies and Fc-fusion proteins can be used to engineer bispecific "superheterodimers" with greater potency than cocktails of the two parent antibodies in their ability to neutralize resistant variants of SARS-CoV-2, direct the killing of cancer cells via antibody-dependent cell cytotoxicity (ADCC), and block the synergistic effects of inflammatory cytokines. Topological engineering represents a new approach for overcoming the challenges in developing combination therapies, particularly in multi-etiologic and resistant disease.

Efforts to make multispecific antibodies that bind targets cooperatively have relied almost exclusively on peptide bonding to connect multiple binding domains. The effectiveness of this approach is limited by the topology of the antibody molecule. The resulting multipartite fusion proteins are often fraught with steric hindrance, preventing the requisite domains from binding their respective targets simultaneously. The key feature defining the topology of the antibody molecule is its dimeric nature, a function of the Fc domain. Although the Fc domain has been used successfully to develop dimeric fusion proteins with many therapeutic advantages such as longer plasma half-lives (1), Fc-fusion proteins are also limited by their antibody-like topology. For example, ACE2-Fc fusion proteins have limited ability to neutralize SARS-CoV-2 due to inefficient binding of the viral spike protein (2-5). ACE2 mutants with affinity-enhancing mutations are not an optimal solution to this problem as they may increase the risk of viral escape. These fundamental limitations were overcome by using non-covalent assembly to create therapeutics with a novel topology compared to that of antibodies. Nature provides many examples of topologically engineered quaternary structures that assemble spontaneously via non-covalent forces (6, 7). Described herein is a new approach using cross-dimerization mediated by the ACE2 collectrin-like domain (CLD) in concert with the Fc domain to create antibody-like molecules with new topologies that bind targets cooperatively.

Example 33

Introduction

HB21-98 (Protein ID 21-98 of Tables 54-57) demonstrated enhanced binding to Fcγ receptors, potent effector functions and efficient depletion of B cells in vitro and in vivo.

B cell-targeting therapies have resulted in major therapeutic benefits in autoimmune diseases and hematological malignancies. However, recent clinical studies suggest that more potent B cell depleting therapies and targeting more than one B cell antigen may result in further improved clinical responses. Described herein is a CD19/CD20 bispecific antibody, HB2198, that was generated using GEM-DIMER™ technology. HB2198 incorporates Fab domains from rituximab and humanized FMC63 (huFMC63) for bivalent binding of both CD19 and CD20 and comprises two enhanced Fc domains to, without limitation, enable powerful effector functions via bivalent binding of Fcγ receptors (FcγR). HB2198 demonstrated robust depletion of human B cells that exceeded the levels observed with comparator anti-CD19 or anti-CD20 IgG1 antibodies in cultures of human whole blood or PBMCs, including PBMCs derived from patients with systemic lupus erythematosus (SLE). Mechanisms of activity of HB2198 include, but are not limited to, enhanced antibody-dependent cellular cytotoxicity (ADCC) and antibody-dependent cellular phagocytosis (ADCP), as well as complement-dependent cytotoxicity (CDC) and direct cell killing activity. HB2198 demonstrated, inter alia, dramatically enhanced binding to FcγR and, hence, exhibited enhanced macrophage-mediated phagocytosis also in the presence of physiological concentration of competing human IgG. In cynomolgus monkeys, HB2198 administration resulted in >99% depletion of circulating B cells within 1-3 days and mediated remodeling of the B cell compartment, as evidenced by, for example, durable shift in proportions of naïve and memory B cells. The data described herein support the conclusion that trispecific HB2198 (targeting CD19, CD20 and FcγR) may provide an improved treatment option when deep and broad depletion of both $CD19^+$ and $CD20^+$ cells is clinically indicated or otherwise preferred to alternate therapeutic modalities.

B lineage cells are a key part of the adaptive immune system and comprise cells of diverse maturation stages and functions. While antibody production is a hallmark of differentiated plasma cells, B lineage cells also play a key role in regulating other immune cells, such as, for example, through antigen presentation, co-stimulation, and cytokine production (see, e.g., McGettigan 2021, Laumont 2022). The immune-modulating functions of B lymphocytes have been corroborated in translational and preclinical studies. B cells were shown to modulate anti-tumor responses, and dysfunction of regulatory B cells has been demonstrated in autoimmune diseases, such as, for example, SLE (see, e.g., Blair 2010, Zacca 2018). B lymphocytes infiltrate multiple tumor types and demonstrate predictive and prognostic significance in the context of both chemotherapy and checkpoint blockade, further suggesting the important immunoregulatory function of these cells (see, e.g., Laumont 2022).

CD19 and CD20 are important therapeutic targets in patients with B cell lymphomas. Although, there is also a strong interest in therapeutic modulation of B lineage cells in multiple other indications due to their fundamental role in regulating tumorigenesis and autoimmune responses. Several approved B cell-depleting therapies are known in the relevant art, including, but not limited to, antibody-drug conjugates, T cell engagers (TCE), CAR-T cells, and antibody variants with enhanced effector functions through, for example, Fc engineering. The clinical benefit of anti-CD20 antibodies has been demonstrated in B cell lymphomas and several autoimmune diseases, such as, for example, multiple sclerosis, rheumatoid arthritis, neuromyelitis optica spectrum disorder (NMOSD), and pemphigus vulgaris (see, e.g., Papageorgiou 2022, Abeles 2024). Interestingly, CD20-targeting agents have demonstrated clinical benefits in these autoimmune diseases, although the primary autoantibody-producing cells, plasma cells or plasmablasts, do not express CD20 (see, e.g., Forsthuber 2018). While CD20 has been the predominant B cell target of interest since the first approval of rituximab in 1997, antibodies targeting CD19, such as, for example, inebilizumab and tafasitamab, have more recently been developed for autoimmune diseases and hematological cancers with demonstrated efficacy in NMOSD and diffuse large B cell lymphoma, respectively (see, e.g., Duell 2021, Cree 2019)

A significant unmet need for more efficacious B cell-depleting therapies remains in both oncology and autoimmune diseases. While encouraging results with CAR-T cells targeting multiple B cell antigens have been observed in select B cell malignancies (see, e.g., Spiegel 2021) all currently approved B cell-depleting agents bind to a single B cell antigen, increasing potential for incomplete depletion and risk of antigen escape mutants. In autoimmunity, depletion of $CD19^+$-$CD20^-$ plasmablasts and pro-B cells may provide additional clinical benefits over anti-CD20 antibodies. In line with this hypothesis, recent studies using CD19-targeting CAR-T cells and TCE demonstrated large reductions in autoantibody levels. Disease activity was also improved; for example, SLE Disease Activity Index-2K (SLEDAI-2K) in patients with SLE and Disease Activity Score 28 (DAS28) in patients with rheumatoid arthritis (see, e.g., Mackensen 2022, Muller, 2024, Bucci 2024). CAR-T cells have been proposed to be more efficacious than conventional antibodies in B cell depletion in lymphoid tissues, which may add to the therapeutic benefits (see, e.g., Mackensen 2022, Muller 2024). Several engineering approaches have also been introduced aiming to enhance, for example, effector functions and, thereby, the efficacy of antibodies. The fragment crystallizable (Fc) region of antibodies plays a critical role in triggering ADCC, ADCP, and CDC and, therefore, has been a key focus for such modifications. For example, afucosylation and introduction of mutations facilitating FcγR binding have been successful in enhancing effector functions of antibodies, including those targeting B cells (see, e.g., Cree 2019, Lazar 2006, Zalevsky 2009, Mossner 2010).

Described herein is a novel CD19- and CD20-targeting antibody, named HB2198, that was generated using the technology described herein (see, e.g., Example 32, Capon 2022) via the incorporation of ACE2 collectrin-like domains (see, e.g., Yan 2020) into the hinge regions of the parental CD19- and CD20-targeting antibodies. HB2198 comprises two Fc domains, both of which incorporate FcγR binding enhancing mutations S239D/I332E ("SD/IE") for potent effector functions, as well as Fab domains derived from humanized FMC63 and rituximab for bivalent binding to CD19 and CD20, respectively. HB2198 demonstrated, inter alia, enhanced B cell depletion, ADCC and ADCP in vitro when compared to rituximab or tafasitamab. In contrast to tafasitamab, HB2198 also exhibited CDC and direct cell-killing activity. In cynomolgus monkeys, a rapid and deep, depletion of circulating B cells (>99%) was followed by remodeling of the repopulating B cell compartment. HB2198 demonstrates significant potential for depletion of $CD19^+$ and $CD20^+$ cells for the treatment of, for example, autoimmune diseases and B cell malignancies.

Results

Structure and Expression of HB2198

HB2198 was generated using the technology described herein (see, e.g., Example 32, Capon 2022). The molecule incorporates two Fab domains each from humanized FMC63 (huFMC63) and rituximab for bivalent binding of both CD19 and CD20, respectively, and comprises two enhanced Fc domains to enable powerful effector functions via bivalent binding of FcγR (see, e.g., FIG. 96, Panel A). Collectrin-like domains derived from ACE2 receptor mediate spontaneous superdimerization of the heavy chains, forming a strong noncovalent bond (see, e.g., Example 32, Capon 2022, Yan 2020). The constant regions of the heavy and light chains are derived from human IgG1 and human Ig kappa, respectively. Each of the heavy chains incorporate the SD/IE double mutation reported by Lazar et al. (see, e.g., Lazar 2006) to enhance FcγR binding. The "H1" chains incorporate the human IgG1 hinge region and a twenty-three amino acid sequence of the human TNF receptor (TNFRSF1B) stem region. The "H2" chains incorporate the complete human IgG1 hinge region. The HB2198 protein was produced as a single secreted protein product by Chinese hamster ovary (CHO) cells stably transfected with four monocistronic DNA expression vectors, each encoding one of the four polypeptide chain types (heavy chain 1 (H1), heavy chain 2 (H2), light chain 1 (L1), and light chain 2 (L2)). An ELISA assay detecting both CD19 and CD20 Fab domains demonstrated comparable and stable levels of HB2197 in PBS containing 1% BSA and human serum during a one-week incubation at 37° C., illustrating the stability of HB2198 in both PBS and serum (FIG. 102).

HB2198 Demonstrates Potent Binding to Both CD19 and CD20

Flow cytometry and Surface Plasmon Resonance (SPR) were used to examine the binding of HB2198 to CD19 and CD20. Pharmaceutical grade rituximab (MabThera®) and a research grade biosimilar of tafasitamab were used as comparators. Comparable binding and functional activities of the tafasitamab biosimilar and pharmaceutical grade tafasitamab (Minjuvi®) were confirmed in cell-based flow cytometry, and ADCC-reporter assays (FIG. 103). HB2198 exhibited dose-dependent binding to human $CD3^-$ $CD40^+$ $CD21^+$ B cells (FIG. 96, Panel B), with an $EC_{50}$ of 3.9±0.27 nM. HB2198 showed somewhat higher maximal fluorescent signals than rituximab, and approximately 3-fold higher maximal fluorescence than huFMC63 or tafasitamab. It should be noted that an anti-human Fcγ antibody was used as a detection antibody, which may have potential to result in higher signal when detecting the dual Fc domains of HB2198.

SPR was used to measure monovalent affinities with immobilized antibody test articles and CD19 and CD20 reagents in the mobile phase. HB2198 bound to human CD19 and human CD20 with $K_D$ values of 1.5 nM and 0.20 nM, respectively, which was comparable to the target binding affinities of rituximab, tafasitamab and huFMC63-SD/IE (Table 84). Thus, HB2198 preserved the binding affinities of the two parental antibodies which it is derived from.

To further illustrate potent and specific binding to both CD19 and CD20 on cells, binding of HB2198 to CD19 and CD20 on the surface of Raji wild-type (WT) ($CD19^+$ $CD20^+$), Raji CD19KO ($CD19^-$ $CD20^+$), Raji CD20KO ($CD19^+$ $CD20^-$) cells was evaluated. The results showed potent binding of HB2198 to all cell types assessed, while rituximab and tafasitamab only bound to cells expressing the relevant target antigen (FIG. 96, Panels C-E). Moreover, transfected HEK293 cells were examined using flow cytometry (FIG. 96, Panels F-H). Non-transfected HEK293 cells showed no binding of HB2198, rituximab, huFMC63, or tafasitamab (FIG. 96, Panel F). HB2198 showed binding similar to that of rituximab and tafasitamab on human CD20 and human CD19 transfected HEK293 cells, respectively (FIG. 96, Panels G and H).

HB2198 Demonstrates Dramatically Enhanced Bivalent Binding to Fcγ Receptors

Both HB2198 and tafasitamab contain SD/IE mutations to increase binding affinity to CD16a, CD32a, and other FcγR, while HB2198 has dual Fc domains as opposed to the one conventional Fc domain of tafasitamab. The monovalent affinities of superdimeric antibodies with dual Fc domains to human FcγR are very similar to conventional antibodies, such as rituximab, when analyzed by immobilizing the antibodies (see, e.g., example 32, Capon 2022). The binding of HB2198 to cynomolgus monkey FcγR was also assessed. The measured monovalent binding affinities of HB2198 to monkey FcγR were comparable to conventional antibodies with SD/IE mutations, within 2-fold when compared to huFMC63-SD/IE and within 4-fold when compared to tafasitamab (Table 87) (Lazar 2006, Gan 2022. However, when bivalent binding can occur, as in FcγR-immobilized format of the SPR assay, HB2198 binding was dramatically enhanced over the conventional comparator antibodies, likely due to cooperative binding (Table 84). In fact, because of the very slow dissociation, the off-rate and, therefore, the apparent $K_D$ of HB2198 for human FcγR could not be precisely determined, except for CD32b/c. Nevertheless, the results showed that the binding affinity of HB2198 for $CD16a_{V158}$, $CD16a_{F158}$, CD16b, $CD32a_{H131}$, $CD32a_{R131}$, CD32b/c and CD64 was increased by >298-fold, >765-fold, >2045 fold, >870-fold, >1165-fold, 3050-fold, and >565-fold when compared to rituximab, respectively. In contrast to HB2198, huFMC63-SD/IE and tafasitamab only showed increased affinities to this set of FcγR ranging from 2.0- to 28.5-fold over rituximab (Table 84). The binding affinities of HB2198 for $CD16a_{V158}$, $CD16a_{F158}$, CD16b, $CD32a_{H131}$, $CD32a_{R131}$, CD32b/c and CD64 were increased by >44-fold, >60-fold, >88 fold, >115-fold, >100-fold, 106-fold, and >278-fold compared to tafasitamab, respectively. The stoichiometry of rituximab and tafasitamab for Fc receptors was approximately 1:1 mAb:FcγRI based on captured mass (RU captured) compared to Rmax. In contrast, HB2198 bound with double the stoichiometry to Fcγ receptors, further indicating that each Fc domain of HB2198 is competent for receptor binding. Thus, the dual Fc domains of HB2198 result in considerably higher affinity for the immobilized FcγR than a conventional single Fc domain containing antibodies.

Combined with the CD19 binding data, these results also illustrate comparable binding properties of huFMC63 and tafasitamab to both CD19 and FcγR. Due to the clinical validation and FDA approval of tafasitamab comprising the SD/IE mutations, tafasitamab was used in subsequent experiments as a comparator anti-CD19 antibody in functional characterization of HB2198.

HB2198 is Superior to Rituximab or Tafasitamab in Depleting Human B Cells In Vitro The ability of HB2198 to deplete B cells was assessed in overnight cultures of fresh human whole blood, since these cultures closely represent the environment of circulating human B cells in vivo. Due to potential interference of HB2198 with the binding of anti-CD19 and anti-CD20 detection antibodies, B cells were identified as $CD3^-$ $CD56^-$ $CD21^+$ $CD40^+$ B cells was determined by flow cytometry as described by Ryan et al. (see, e.g., Ryan 2014). HB2198 resulted in superior B cell depletion in four out of four whole blood cultures when compared to rituximab or tafasitamab (FIG. 97, Panels A and B). Activation of NK cells was also observed in these cultures, as evidenced by, for example, elevated expression of CD69, with a trend toward enhanced activity when compared to rituximab or tafasitamab (FIG. 97, Panel C).

Subsequently, the ability of HB2198 to induce B cell depletion in PBMCs from healthy and SLE patient donors was assessed. SLE patients were included because B cell depletion in SLE has demonstrated encouraging clinical results (Mackensen 2022, Furie 2022, Muller 2024) and the reported resistance of B cells in SLE patients to depletion compared to those from healthy volunteers (Reddy 2015). In PBMC samples from healthy volunteers, HB2198 consistently depleted approximately 80% of B cells in four independent donors and resulted in more potent B cell depletion in each donor when compared to rituximab or tafasitamab (FIG. 97, Panels D and E). HB2198 demonstrated potent B cell depleting activity also in PBMCs from patients with SLE and maximum B cell depletion was more potent in 7/7 or 6/7 donors when compared to rituximab or tafasitamab, respectively (FIG. 97, Panels F and G). The PBMC culture data further illustrated more potent B cell depleting activity of HB2198 when compared to rituximab or tafasitamab.

HB2198 is Superior to Rituximab and Tafasitamab in ADCC Activity In Vitro

Several mechanisms of action have been reported for B cell depleting antibodies targeting CD19 or CD20, including ADCC, ADCP, CDC, and direct cell killing activity (Uchida 2004, Schewe 2017, Herbst 2010). The ability of HB2198 to activate ADCC was assessed using co-cultures of human PBMCs and Raji human B cell lymphoma cells expressing both CD19 and CD20. HB2198 induced potent, dose-dependent ADCC in Raji cells in three separate donors (FIG. 98). The overall cytotoxicity mediated by HB2198 was enhanced over both rituximab and tafasitamab, independently whether the donor was 158V/V or 158V/F for FcgRIIIa genotype. In addition, HB2198 induced potent ADCC in Raji CD19 KO and Raji CD20 KO cell lines, indicating that the activity is not dependent on expression of both targets. As expected, rituximab induced ADCC in Raji WT and Raji CD19 KO, but not in Raji CD20 KO. Conversely, tafasitamab induced ADCC in Raji WT and Raji $C_{20}$ KO, but not Raji CD19 KO. The data demonstrated superior ADCC activity of HB2198 on Raji lymphoma cell line and indicated that one target antigen is sufficient to trigger ADCC activity by HB2198.

HB2198 is Superior to Rituximab or Tafasitamab in ADCP Activity In Vitro and Retains Potent Activity in the Presence of Competing Human IgG ADCP by macrophages is a predominant mechanism of action of anti-CD20 and Fc-enhanced anti-CD19 antibodies in vivo, particularly in select tissues (Uchida 2004, Schewe 2017, Bruggeman 2019). It was hypothesized that the enhanced affinity of HB2198 to FcγR via the SD/IE mutations and dual Fc domains may enhance ADCP activity of HB2198. Competing human IgG downregulates ADCP activity of B cell targeting antibodies, including both wild-type and afucosylated anti-CD20 mAbs (Herter 2014). As such, an ADCP assay was performed in the presence of 10 mg/mL human IgG, which is approximately the median serum IgG concentration in the general adult population (Gonzalez Quintela).

Primary CD14+ cells were differentiated into macrophages with M-CSF and co-cultured with target cells. Addition of HB2198 led to a dose-dependent increase in human macrophage uptake of fluorescently labeled Raji WT cells both in the absence and presence of competing human IgG.

In the presence of 10 mg/mL human IgG, HB2198 resulted in a higher maximum uptake than either rituximab or tafasitamab (FIG. 99). HB2198 was approximately 3-fold more potent ($EC_{50}$ 2.62±2.7 nM) than rituximab ($EC_{50}$ 7.8±8.7 nM) and comparable to tafasitamab ($EC_{50}$ 1.6+1.9 nM). The data described herein indicated that HB2198 has increased ADCP activity on Raji WT cells expressing both CD19 and CD20 antigens.

Further, HB2198 resulted in potent phagocytosis of both $CD19^-$ CD20+ and $CD19^+$ $CD20^-$ target cells, in the presence and absence of competing human IgG (FIG. 99). Rituximab and tafasitamab had no activity in $CD19^+$ $CD20^-$ and $CD19^-$ $CD20^+$ target cells, respectively. These data indicate that HB2198 exhibits ADCP activity on both $CD19^+$ or $CD20^+$ target cells, further illustrating that one target antigen is sufficient to mediate the activity. Importantly, HB2198 substantially outperformed both comparator molecules, including tafasitamab, in phagocytosis of $CD19^+$ $CD20^-$ target cells, which is the phenotype of autoantibody-producing plasmablasts (Forsthuber 2018).

HB2198 Exhibits CDC Activity and Direct Cell Killing In Vitro

CDC and direct cell death have also been reported to contribute to antibody-mediated B cell depletion, while relative roles in vivo are still under investigation (Herbst 2010, Horton 2008, Constantinides 2023). Direct cell death has been described for both rituximab and Fc-enhanced anti-CD19 antibodies, while anti-CD19 antibodies are not known to mediate CDC (Herbst 2010, Horton 2008, Constantinides 2023). Given that HB2198 merges an anti-CD19 and an anti-CD20 antibody, CDC and direct killing potential of the molecule we analyzed.

HB2198 induced dose-dependent CDC in Raji and SU-DHL-4 cells with comparable maximum activity between HB2198 and rituximab, while the potency of HB2198 was somewhat reduced from rituximab in both cell lines (FIG. 100). Tafasitamab consistently did not have CDC activity as previously reported (Horton 2008). We next studied the direct effects of HB2198, rituximab and tafasitamab on survival of target cells in the absence of any effector cells. HB2198 mediated a dose-dependent inhibition of SU-DHL-4 cell survival. The potency of HB2198 was enhanced over rituximab and HB2198 triggered higher maximum cytotoxicity than tafasitamab, while rituximab reached the highest overall effect in this experiment (FIG. 100, Panel C). The data suggested that some of the mechanisms of action of HB2198 include CDC and direct, effector cell-independent, killing.

Binding of HB2198 to Cynomolgus Monkey CD19, CD20 and FcγR and Depletion of Monkey B Cells To evaluate the relevance of non-human primates as species for in vivo studies, the binding of HB2198 to cynomolgus monkey CD19, CD20 and FcγR and its ability to deplete B cells in cultures of cynomolgus monkey whole blood was assessed. The affinities of HB2198 and rituximab to cynomolgus monkey CD20 were 1.4±0.11 and 1.1±0.16 nM, respectively (Table S2), which is comparable to that observed for human CD20 (Table 84). The binding of HB2198, huFMC63 and tafasitamab to cynomolgus CD19 was considerably weaker than that to human CD19, with average $K_D$ values of 410 nM (n=11), 470 nM (n=11) and 1800 (n=4), respectively (Derebe 2018, Boesch 2017). In contrast, based on the data observed with human FcγR (Table 85), HB2198 demonstrated dramatically enhanced affinity on cynomolgus monkey FcγR when bivalent binding could occur, with 24-90-fold or 214-1056-fold enhancement over tafasitamab or rituximab, respectively (Table 86).

Similar to what was exhibited in human whole blood cultures, HB2198 showed potent binding to cynomolgus B cells with comparable EC50 and maximum binding when compared to human B cells (FIG. 101, Panel A; FIG. 104, Table 88, Table 89), while both HB2198 and tafasitamab bound weaker to HEK293 cells expressing cynomolgus CD19 compared to HEK293 expressing human CD19, by 67-fold and 15-fold, respectively (FIG. 101, panel B; FIG. 96, panel H). HuFMC63 and tafasitamab also had reduced and less consistent binding to and activity on cynomolgus monkey B cells compared to human B cells (FIG. 101, Panel A; FIG. 96, Panel B). These results are consistent with the weak binding of huFMC63 and tafasitamab to cynomolgus monkey CD19 determined by SPR (Table 88). Importantly, HB2198 induced potent (2±0.2 nM) depletion on cynomolgus monkey B cells in overnight cultures, with maximum activity comparable to that observed in cultures of human whole blood (FIG. 97, Panels A and B, FIG. 101, Panel C). These data indicate that cynomolgus monkey is a relevant species for pharmacological evaluation of HB2198.

Infusion of HB2198 in Cynomolgus Monkeys Results in Rapid and Deep B Cell Depletion To evaluate the efficacy of HB2198 in inducing B cell depletion in vivo, HB2198 was administered via IV infusion to cynomolgus monkeys at 0.2, 1, 5, and 25 mg/kg as a single dose or at 25 mg/kg twice on Days 0 and 14. Similar to previously published studies (Ryan 2014), CD40 was used as a CD19− and CD20-independent B cell marker as HB2198 may mask the binding of anti-CD19 and anti-CD20 antibodies (Ryan 2014).

Potent and deep dose-dependent B cell depletion was already observed one day following administration of HB2198 (FIG. 101, Panels D and E). A single infusion of 1, 5 or 25 mg/kg led to approximately 99% depletion of $CD40^+$ B cells as early as 1 day post infusion and B cells remained approximately 99% depleted at Day 3 post-treatment. Up to 99.3% and 99.9% depletion of peripheral B cells was observed in 5 and 25 mg/kg cohorts on Day 3, respectively. Peripheral B cells also remained >95% and >99% depleted at Day 7 in the 5 mg/kg and 25 mg/kg groups, respectively. B cell counts slowly returned toward baseline with higher dose groups taking longer to repopulate their B cell compartments. At the highest dose examined, the 25 mg/kg infused animals had the slowest recovery, remaining below 50% repletion (average 39% of baseline B cell numbers) at Day 84 (FIG. 101, Panel D).

A cohort of four animals received two doses of 25 mg/kg HB2198, 14 days apart, matching the initial clinical dosing schedule used for both anti-CD19 and anti-CD20 antibodies in the treatment of autoimmune diseases (Cree 2019, Furie 2022). Approximately 99% depletion of peripheral B cells was observed by Day 1 post infusion and peripheral B cells remained at <90% until the second infusion 14 days later (FIG. 101, Panel F). After the second infusion, $CD40^+$ B cell numbers dropped again to >99% depletion at 24 hrs post-dose. On average B cell numbers recovered to approximately 50% of baseline at Day 84 post first infusion and remained at 71% of baseline until Day 140. The number of T cells and NK cells in the lymphocyte compartment were only transiently affected by HB2198, with NK cells transiently depleted on Days 1 and 3, returning to baseline by Day 7 post-infusion.

The proportion and number of $CD27^+$ memory B cells was tracked during depletion and repletion of cynomolgus monkeys treated with HB2198. Memory B cells were effectively depleted at Day 1 post-infusion, similar to naïve B cells. Interestingly, the proportion of $CD27^+$ memory cells of total B cells remained significantly lower than baseline after 3 months for all single-dose groups as well as two-dose cohort (FIG. 101, Panels G to I). Conversely, $CD27^-$ (naïve) B cells increased in percentage of total B cells during repopulation of all animals (FIG. 101, Panel G). The two-dose cohort also maintained a lower proportion of memory B cells at 3 months post infusion compared to the single dose cohort (FIG. 101, Panels H-I). These data suggested that effective depletion of accumulated memory B cells by HB2198 allows for less activated CD27-naïve B cells to repopulate the immune system in a healthy animal. Overall, these data indicate potent in vivo depletion of B cells in cynomolgus monkeys and suggest remodeling of the B cell compartment with an altered ratio of naïve vs memory B cells.

Tables

TABLE 84

Binding of HB2198, rituximab, huFMC63 and Tafasitamab to Human and CD19 and CD20.

| | $K_D$ ± SD (nM) | |
|---|---|---|
| | Human CD19 | Human CD20 |
| HB2198 | 1.5 ± 0.92 | 0.20 ± 0.09 |
| Rituximab | NB | 0.46 ± 0.13 |
| huFMC63 | 2.7 ± 0.85 | NB |
| Tafasitamab | 1.4 ± 0.50 | NB |

For HB2198 and huFMC63, n = 11, rituximab n = 10, tafasitamab n = 4 determinations.
Values are mean ± standard deviation rounded to two significant figures.
NB: no binding.

TABLE 85

Binding of HB2198, Rituximab, huFMC63, Rituximab-SD/IE, huFMC63-SD/IE and Tafasitamab to Immobilized Human FcγR.

| | CD16a-158V | | CD16a-158F | | CD16b | | CD32a-131H | |
|---|---|---|---|---|---|---|---|---|
| | $K_D$ (nM) | Fold | $K_D$ (nM) | Fold | $K_D$ (nM) | Fold | $K_D$ (nM) | Fold |
| Mab Thera (Rituximab) | 595.4 | 1.0 | 1534.6 | 1.0 | 4085.3 | 1.0 | 1738.9 | 1.0 |
| huFMC63 | 431.3 | 1.4 | 968.3 | 1.6 | 2254.0 | 1.8 | 1106.5 | 1.6 |
| huFMC63 S239D/1332E | 90.9 | 6.5 | 112.6 | 13.6 | 175.6 | 23.3 | 250.9 | 6.9 |
| Tafasitamab | 88.9 | 6.7 | 120.8 | 12.7 | 175.7 | 23.3 | 231.0 | 7.5 |
| HB2198 | <2 | >298 | <2 | >765 | <2 | >2045 | <2 | >870 |

| | CD32a-131R | | CD32b/c | | CD64 | |
|---|---|---|---|---|---|---|
| | $K_D$ (nM) | Fold | $K_D$ (nM) | Fold | $K_D$ (nM) | Fold |
| Mab Thera (Rituximab) | 2332.7 | 1.0 | 6676.6 | 1.0 | 11.3 | 1.0 |
| huFMC63 | 1229.5 | 1.9 | 2182.3 | 3.1 | 9.0 | 1.3 |
| huFMC63 S239D/1332E | 237.9 | 9.8 | 275.4 | 24.2 | 4.4 | 2.6 |
| Tafasitamab | 203.0 | 11.5 | 234.2 | 28.5 | 5.6 | 2.0 |
| HB2198 | <2 | >1165 | 2.2 | 3050 | <0.02 | >565 |

Binding was measured by Biolayer Interferometry (BLI) using an Octet Red384 (Sartorius Stedim Biotech, France).
*Fold represents the $K_D$ of rituximab divided by the $K_D$ of the comparator.

TABLE 86

Binding of HB2198, Rituximab, huFMC63, huFMC63-SD/IE and Tafasitamab to Immobilized Cynomolgus FcγR

| | CD16 | | CD32a | | CD32b | | CD64 | |
|---|---|---|---|---|---|---|---|---|
| Sample ID | $K_D$ (nM) | Fold | $K_D$ (nM) | Fold | $K_D$ (nM) | Fold | $K_D$ (nM) | Fold |
| MabThera (Rituximab) | 424.6 | 1.0 | 5940.3 | 1.0 | 3635.7 | 1.0 | 10.3 | 1.0 |
| huFMC63 | 422.8 | 1.0 | 2913.4 | 2.0 | 1873.0 | 1.9 | 8.3 | 1.2 |
| huFMC63 S239D/133E | 53.4 | 7.9 | 233.3 | 25.5 | 196.1 | 18.5 | 1.0 | 10.0 |
| Tafasitamab | 49.5 | 8.6 | 181.4 | 32.8 | 152.2 | 23.9 | 1.8 | 5.7 |
| HB2198 | 2.0 | 214 | 4.0 | 1498 | 3.4 | 1056 | <0.02 | >515 |

TABLE 87

Binding of Cynomolgus Fcγ Receptors to Immobilized HB2198, Mab Thera, huFMC63, huFMC63S239D/1332E and Tafasitamab

| | CD16 | | CD32a | | CD32b | | CD64 | |
|---|---|---|---|---|---|---|---|---|
| | $K_D$ (M) | *Fold | $K_D$ (M) | *Fold | $K_D$ (M) | *Fold | $K_D$ (M) | *Fold |
| MabThera (Rituximab) | 1.30E−07 | 1.0 | 3.13E−06 | 1.0 | 1.46E−06 | 1.0 | <2.00E−11 | ND |
| huFMC63 | 1.48E−07 | 0.9 | 1.61E−06 | 1.9 | 1.29E−06 | 1.1 | <2.00E−11 | ND |
| huFMC63 S293D/1332E | 1.57E−09 | 82.4 | 1.88E−07 | 16.6 | 1.29E−07 | 11.3 | <2.00E−11 | ND |
| Tafasitamab | 1.34E−09 | 96.6 | 7.62E−08 | 41.1 | 5.30E−08 | 27.5 | <2.00E−11 | ND |
| HB2198 | 1.76E−09 | 73.8 | 3.05E−07 | 10.3 | 2.18E−07 | 6.7 | <2.00E−11 | ND |

Binding was measured using SPR, except that cynomolgus FcγR were captured on the Carterra chip.
*Fold represents the $K_D$ of MabThera divided by the $K_D$ of the comparator.
Dissociation of CD64 from all test articles not be measured accurately in this assay.

TABLE 88

Binding of HB2198, rituximab, huFMC63 and Tafasitamab to Cynomolgus Monkey CD19 and CD20

| | $K_D$ ± SD (nM) | |
|---|---|---|
| | Cynomolgus CD19 | Cynomolgus CD20 |
| HB2198 | 410 ± 410 | 1.4 ± 0.11 |
| Rituximab | NB | 1.1 ± 0.16 |
| huFMC63 | 470 ± 320 | NB |
| Tafasitamab | 1800 ± 840 | NB |

The binding of recombinant cynomolgus CD19 and CD20 proteins to immobilized HB2198, MabThera, huFMC63 and tafasitamab was measured using SPR on a Carterra LSA Instrument.
Data were analyzed using a 1:1 Langmuir binding model with the Carterra Kinetics Software.
For HB2138 and huFMC63, n = 11, MabThera n = 10, tafasitamab n = 4 determinations.
Values are means ± SD.
NB: no binding.

TABLE 89

Summary of HB2198 and Comparators Binding to Human and Cynomolgus B Cells

| | Healthy Human (N = 3) | | Cynomolgus Monkey (N = 3) | |
|---|---|---|---|---|
| | $EC_{50}$ (nM) | $E_{max}$ (gMFI × $10^{-3}$) | $EC_{50}$ (nM) | $E_{max}$ (gMFI × $10^{-3}$) |
| HB2198 | 3.9 ± 0.27 | 170 ± 14 | 2.1 ± 0.26 | 140 ± 7.5 |
| MabThera | 0.90 ± 0.10 | 120 ± 10 | 0.61 ± 0.16 | 99 ± 2.2 |
| huFMC63 (S239D/1332E) | 1.1 ± 0.28 | 67 ± 5.8 | 37 ± 18 | 16 ± 3.1 |
| Tafasitamab | 1.0 ± 0.64 | 55 ± 5.7 | 57 ± 100 | 32 ± 18 |
| Human IgG1 | 12 ± 3.2 | 3.2 ± 0.42 | 8.5 ± 4.9 | 2.7 ± 1.2 |

$EC_{50}$ and $E_{max}$ values were determined from experiments in FIG. 100.

TABLE 90

Mean serum pharmacokinetic parameters of HB2198 following single or repeat administration by IV infusion in male and female cynomolgus monkeys.

| Analyte | HB2198 | | | | | |
|---|---|---|---|---|---|---|
| Route | IV Infusion (1h) | | | | | |
| Group | 5 | 1 | 2 | 3 + 4 | 4 | 4 |
| Dose (mg/kg) | 0.2 | 1 | 5 | 25 | 25 | 25 |
| Study Day | | | 0 | | | 14 |
| $C_0$ (μg/mL) | 0 | 0 | 0 | 0 | 0 | 0 |
| Cmax (μg/mL) | 2.51 ± 0.297 | 13.9 ± 1.35 | 97.4 ± 6.23 | 644 ± 140 | 666 ± 72.0 | 635 ± 102 |
| Tmax (h)[a] | 1 | 1 | 1 | 1 | 1 | 1 |
| AUC0-t (μg*h/mL) | 23.6 ± 5.12 | 124 ± 27.8 | 1060 ± 113 | 6090 ± 1740 | 6690 ± 1380 | 4110 ± 582 |
| AUC0-inf (μg*h/mL) | 23.9 ± 5.24 | 127 ± 27.5 | 1060 ± 115 | 6090 ± 1740 | 6690 ± 1380 | 4120 ± 581 |
| $t_{1/2}$ (h) | 14.9 ± 9.02 | 22.1 ± 7.37 | 24.1 ± 4.45 | 21.8 ± 2.75 | 22.8 ± 2.89 | 3.50 ± 1.73 |
| CL (mL/h/kg) | 8.56 ± 1.87 | 8.10 ± 1.76 | 4.75 ± 0.515 | 4.47 ± 1.63 | 3.85 ± 0.746 | 6.16 ± 0.890 |
| Vz (mL/kg) | 172 ± 71.2 | 249 ± 30.1 | 163 ± 12.6 | 139 ± 46.0 | 126 ± 24.1 | 30.3 ± 12.0 |

Values are mean ± standard deviation (SD). Groups 3 and 4 were dosed with 25 mg/kg on Day 0. Group 4 received a repeat dose of 25 mg/kg on Day 14. HB2198 serum concentrations were determined using Technical Procedure NC0001.
[a]Median (range) is presented for Tmax Discussion The data described in this Example demonstrated trispecific targeting of CD19, CD20 and FcγR with HB2198, a superdimeric antibody with dual Fc-domains. Superdimerization of antibodies, without limitation, via collectrin-like domain from ACE2 receptor allowed for the generation of multispecific, multivalent molecules from various combinations of parental antibodies or Fc-fusion proteins (Example 32, Capon 2022). HB2198 was generated via superdimerization of CD19- and CD20-targeting antibodies derived from huFMC63 and rituximab, respectively. The two Fc domains of HB2198 are functionally bivalent for FcγR binding resulting in, inter alia, dramatically enhanced affinity. HB2198 consistently mediated superior effector functions in vitro when compared to the parental antibodies and mediated rapid and deep B cell depletion in cynomolgus monkeys.

Antibody-like molecules with two Fc domains in tandem configuration have been described before, with enhanced affinity to FcγR (Wang 2017, Nagashima 2008, Nagashima 2011). However, further development of these constructs has not been reported, partly due to challenges in protein expression and stability. Specifically, anti-*Klebsiella pneumonia* antibodies with two Fc domains in tandem exhibited relatively poor stability and low production levels and were not advanced into rodent studies for these reasons (Wang 2017). In vitro characterization of an anti-CD20 antibody with dual tandem Fc domains was also reported with enhanced ADCC and ADCP function, while no protein scale-up or in vivo studies were performed (Nagashima 2008, Nagashima 2011). GEM-DIMER technology enables one to merge two full-length antibodies, allowing for parallel orientation of the two Fc domains and for bivalent targeting of antigens of interest, while retaining the many beneficial characteristics of conventional antibodies. HB2198, demonstrated serum stability and successful protein scale-up for studies in non-human primates (e.g., cynomolgus monkeys).

HB2198 resulted in deeper human B cell depletion than rituximab or tafasitamab in vitro. The effects of HB2198 appeared to be mediated via multiple mechanisms as it demonstrated, without limitation, enhanced ADCC and ADCP activities, and HB2198 also incorporated the CDC and direct cell killing activities of rituximab. In contrast, tafasitamab lacked CDC activity, consistent with published reports (Horton 2008). The direct killing activity of HB2198 also was enhanced over tafasitamab further illustrating another unique set of (non-limiting) mechanisms by which HB2198 can eliminate its CD19-expressing target cells. Particularly in diseases with reduced effector cell function, such as, for example, in SLE (Nagashima 2011), or when the target cell is surrounded by high levels of immunoglobulin, as in the case of autoantibody-producing cells, it is generally important that an antibody-based drug can outcompete endogenous IgG for FcγR binding. HB2198 demonstrated a significantly enhanced ADCP function even in the presence of physiological concentration of human IgG (10 mg/ml). Given these results and that macrophages are considered one of the key cells mediating the activity of therapeutic antibodies in tissues (Uchida 2004, Schewe 2017, Bruggeman 2019), HB2198 has the potential to induce effector function not only by opsonizing target cells (for example) but also by, without limitation, efficiently outcompeting endogenous IgG to bind FcγR on effector cells.

Bispecific targeting of CD19 and CD20 may provide therapeutic benefits over therapies targeting either antigen alone, especially when leveraged using the technology described herein, as exemplified by the data generated using HB2198 described herein. HB2198 exhibited potent binding to both $CD19^-$ $CD20^+$ and $CD19^+$ $CD20^-$ cells and it was active on both types of target cells indicating that one antigen binding domain, combined with the dual enhanced Fc domains, was sufficient for the potent activity of HB2198. As such, HB2198 appears to have therapeutic potential for depletion of not only $CD19^+$ plasmablasts but also CD20-expressing pathogenic T cells, which have been reported to occur at least partly through the acquisition of CD20 from activated B cells via trogocytosis (Ochs 2022). These $CD20^+$ T cells play a role in proinflammatory autoimmune responses, and elimination of $CD20^+$ $CD19^-$ T cells appear to contribute to the beneficial effects of CD20-targeting B cell depleting therapies in autoimmunity (Ochs 2022, Wilk 2009, Palanichamy 2014). In addition to the benefits of dual CD19- and CD20-targeting in autoimmune diseases, bispecific antigen targeting is also hypothesized to reduce the risk of antigen escape variants in the treatment of B cell lymphomas, a known mechanism of treatment failure (Hiraga 2009, Majzner 2018).

B cell depletion following administration of HB2198 into cynomolgus monkeys was rapid and deep. Depletion of approximately 99% of circulating CD40+ B cells was observed already on Day 1, and up to 99.9% depletion was observed on Day 3. The data compares favorably to previous studies with rituximab. Specifically, Ryan et al reported an average of 87.3% and 88.3% depletion of $CD40^+$ B cells three days following administration of rituximab at doses of 10 mg/kg and 20 mg/kg, respectively (Ryan 2014). These data are particularly noteworthy because, due to the low cross-reactivity of huFMC63 on cynomolgus monkey CD19, the in vivo activity of HB2198 is likely primarily attributable to CD20 binding combined with the dual Fc domains with enhanced FcγR binding. However, contribution of CD19 binding in vivo cannot be ruled out, particularly at the higher dose levels. Importantly, the results also illustrate a HB2198-mediated remodeling of the B cell compartment as the relative portion of naïve CD27-B cells increased and the proportion of $CD27^+$ memory B cells decreased following administration. The reduction in the percentage of memory B cells was most significant in animals that received two doses of HB2198, suggesting that repeat dosing further enhance activity in lymphoid tissues, such as, for example, spleen, bone marrow and lymph nodes, where memory B cells reside (Akkaya 2020). An analogous shift in naïve and memory B cells has been observed in autoimmune patients treated with B cell depleting therapies and the rate of memory B cell recovery correlated with the likelihood of relapse (Bucci 2024, Muller 2024, Vital 2011, Ruetsch-Chelli 2021). In patients treated with CD19-targeting CAR-T or TCE, these changes in B cell compartment also associated with reductions in autoantibody levels through depletion of $CD19^+$ plasmablasts (Bucci 2024, Muller 2024). It should be noted that, generally, memory B cells are more abundant in patients with autoimmune disease than in healthy controls (Ruetsch-Chelli 2021), and hence, it is plausible that such changes in memory B cells are more readily observed in patients with automimmune disease than healthy individuals. It is believed that the data described herein is the first to demonstrate a durable shift in memory B cell compartment in healthy non-human primates (e.g., cynomolgus monkeys).

In view of the foregoing, HB2198 represents a novel class of therapeutic antibodies with dual enhanced Fc domains. HB2198 is a promising candidate to provide deep depletion of both $CD19^+$ and $CD20^+$ cells. The demonstrated potent activity in vitro and in vivo support the advancement of HB2198 in multiple indications where depletion of $CD19^+$ and $CD20^+$ B cells is clinically indicated or otherwise desirable.

Materials and Methods

Cell Lines and Blood Samples

B cell lymphoma lines Raji (ATCC #CCL-86), Raji CD19KO (Sigma ATG001), Raji CD20KO (Abcam ab273871), SU-DHL-4 (ATCC #CRL-2957), TOLEDO (ATCC #CRL-2631) were cultured in RPMI1640+GlutaMAX (Gibco) supplemented with 10% fetal bovine serum (Gibco). Low passage cell line stock vials were stored in LN2 and vials sub-cultured twice per week for up to 8 weeks post thaw. Frozen human and cynomolgus monkey PBMCs were purchased from BioIVT and thawed just prior to use. Fresh human (Stanford University) and cynomolgus monkey whole blood (Alpha Genesis) from healthy donors was collected in heparinized tubes and shipped overnight at ambient temperature.

HEK293 cells expressing human or cynomolgus monkey CD19 were generated by transfection using Lipofectamine 3000 (Invitrogen). Stable clones were generated by hygromycin selection on 10 cm dishes and isolated using cloning cylinders. Clones were screened for CD19 expression and used for subsequent binding assays. Plasmids were designed using VectorBuilder tools (VectorBuilder, Inc.), with CAG promoter driving expression of human or cynomolgus monkey CD19 (GenBank Accession #s NM_001178098.2 and XM 005591540.3, respectively, the contents of which are incorporated by reference herein in their entirety). HEK293 cells expressing human CD20 were purchased from ACRO Biosystems (Catalog #CHEK-ATP034).

Expression and Purification of HB2198

The HB2198 protein and control antibodies were produced as a single secreted protein product by CHO cells. In vitro studies were performed with HB2198 produced from transient transfection, while a stable cell line was generated for preclinical development, including NHP study in cynomolgus monkeys. CHO cells were transfected with four monocistronic DNA expression vectors, each encoding one of the four polypeptide chain types (H1, H2, L1, and L2). Generation of stable cell line, clone 10, and subsequent protein production of was carried out by ExcellGene SA (Monthey, Switzerland).

The HB2198 and control antibodies were purified by Protein A affinity chromatography. Affinity chromatography was carried out by applying the supernatant to a column packed with the CaptivA Protein A Affinity Resin (Repligen, MA) pre-equilibrated with phosphate buffered saline (PBS) (137 mM NaCl, 2.7 mM KCl, 10 mM Na2HPO4, 2 mM KH2PO4 pH 7.4). The column was washed with PBS until the OD280 value returned to baseline. Target protein was then eluted with 0.25% acetic acid at pH 3.5. Fractions were collected, buffered with 1 M HEPES, and fractions containing the target protein were pooled, buffer exchanged into 100 mM HEPES, 100 mM NaCl, 50 mM sodium acetate, pH 6.0, filtered through a 0.2 μm membrane filter and stored at 4° C. prior to use. The protein concentration was calculated from the OD280 value and calculated extinction coefficient.

Endotoxin levels in purified samples were determined using EndoChrome-K Kinetic LAL assay and/or Endosafe-PTS cartridges (Charles River) according to manufacturer instructions (limit of detection 0.01 EU/mg).

CD19, CD20 and FcγR binding

The binding of recombinant human or cynomolgus monkey CD19 and CD20 proteins to immobilized HB2198 and comparators was measured using SPR on a Carterra LSA Instrument. HB2198 and comparator antibodies were captured at densities of 588 Resonance Units (RU) and 330 respectively, on a CMDP chip containing covalently coupled anti-human Fc antibody. CD19 binding was conducted in HEPES buffer (10 mM HEPES, 150 mM NaCl, 3 mM EDTA, with 0.005% Tween-20, pH 7.4 with 0.05 mg/ml BSA). CD20 binding using recombinant full-length CD20 was conducted in HEPES buffer containing 0.05% n-Dodecyl-β-D-maltoside (DDM) and 0.01% cholesteryl hemisuccinate (CHS). Titrations were carried out in 3-fold dilution series with top concentrations of 167 nM for human and cynomolgus monkey CD20, 500 nM for human CD19, and 5,000 nM for cynomolgus CD19. Data were analyzed using a 1:1 Langmuir binding model with the Carterra Kinetics Software.

FcγR binding was measured by Biolayer Interferometry (BLI) using an Octet Red384 (Sartorius Stedim Biotech, France) with HEPES buffer at 26° C. with orbital shaking speed of 1000 rpm. Human FcγR were captured on anti-penta-histidine biosensors (Sartorius) at 5 μg/mL. Biosensors were then incubated in varying concentrations of test compounds for 15 seconds, followed by a 60 second dissociation incubation in HEPES buffer. Data was analyzed using a standard 1:1 binding model. Twofold serial dilutions were analyzed with the following top concentrations: $CD16a_{V158}$, 2 μM; $CD16a_{F158}$, 5 μM; CD16b, 12 μM; $CD32a_{H131}$, 10 μM; $CD32a_{R131}$, 10 μM; CD32b/c 10 μM; and CD64, 2.5 nM. Data were analyzed using a 1:1 Langmuir binding model with the Octet Analysis Studio 13.0 (Sartorious).

Cell Binding

Target cells or PBMCs were incubated with blocking cocktail (5 μg/mL human BD Fc Block™, BD Biosciences; and 10 μg/mL human AffiniPure™ $F(ab')_2$ Fragment IgG, Fcγ specific, Jackson ImmunoResearch), washed with staining buffer (1×PBS/2% FCS/1 mM EDTA), and cells ($2\times10^4$, target cells; $1\times10^5$, PBMCs) were plated in U-bottom non-coated assay plates with a titration of test antibodies for 30 minutes on ice. Cells were washed, then incubated with Live/Dead-NIR (Thermo Fisher) and 5 μg/mL PE (phycoerythrin) anti-human IgG, Fcγ specific polyclonal antibody (eBiosciences) for 30 minutes on ice. Cells were washed, fixed with 1% PFA, and returned to staining buffer then analyzed with flow cytometry (NovoCyte, Agilent). Binding data was measured by PE+ live lymphocytes (target cells) or PE+ live B cells (PBMCs) determined by $CD3^-CD40^+$ (cynomolgus monkey) and $CD3^-CD21^+CD40^+$ (human) using FlowJo software (TreeStar).

Direct Cell Killing

Target expressing cells were plated in RPMI medium at a density of $5\times10^4$ cells per well into 96-well plates and cocultured with titrated antibody for 48 hours at 37° C./5% $CO_2$. Cell viability was then assessed through bioluminescent ATP (CellTiter-Glo) and read on a SpectraMax iD3 plate reader. Specific cytotoxicity was calculated as follows: 100×(1−(treated sample/untreated sample)).

B Cell Depletion in Human and Cynomolgus Monkey Whole Blood

Heparinized peripheral blood collected from human donors (Stanford Blood Center) and cynomolgus monkeys (Alpha Genesis) were analyzed. Briefly, 90 μL of blood was incubated with 10 μL of indicated test antibody concentrations diluted to 10 times the desired final concentration. After 18 hours, human samples were stained with antibodies against CD3, CD56, CD69, CD21 and CD40 for 30 min at 25° C. The same antibody cocktail was used for monkey samples except for CD159a, which was substituted for CD56. Samples were depleted of erythrocytes with RBC Lysis Buffer (EBiosciences) for 15 min at 25° C. before washing twice and resuspended in FACS Buffer (BD Biosciences) before being analyzed immediately with flow cytometry (NovoCyte). Lymphocytes were gated and B cells were determined by the number of positive $CD3^-$ $CD56^-$ $CD21^+$ $CD40^+$ (human) and $CD3^-$ $CD159a^-$ $CD40^+$ (cyno) cells. Percent B cell depletion was calculated as follows: 100×(1−(treated sample/untreated sample)). NK cell activation was analyzed from the same samples by gating on lymphocytes and determining the number of $CD69^+$ $CD56^+$ (human) or $CD159a^+$ (cyno) NK cells.

ADCC

Target cells were first labeled with ViaFluor 405 (VF405) [ThermoFisher] before plating $1\times10^4$ cells per well in a 96-well round bottom plate. Labeled target cells were then incubated with test antibodies at 7 concentrations using 5-fold dilutions in a total volume of 100 μL. After 15 minutes in a 37° C. CO2 incubator, $2.5\times10^5$ PBMCs were added at an E:T ratio of 25:1. After a 4 hour incubation at 37° C., 5% $CO_2$, cells were washed, stained with propidium iodide (PI) and analyzed by flow cytometry. Cytotoxicity was expressed as the percentage of cells staining positive for both $VF405^+$ and PI.

ADCP

Target cells were labeled with 1 μM pHrodo Green AM (ThermoFisher) for 30 minutes per manufacturer's instructions and $2\times10^4$ cells plated in RPMI1640/10% FBS with addition of test antibody titration in triplicate 10 minutes prior to the addition of effector cells. M2 macrophages were differentiated with M-CSF (PeproTech) from primary human CD14+ cells (BioIVT) for 5-7 days and labeled with 1 μM CellTrace Violet (CTV, Thermo Fisher) for 10 minutes and washed twice with RPMI/10% FBS prior to use. $1\times10^4$ macrophage cells were added as effectors cells at ET ratio of 1:2, with pHrodo-Green labeled target cells and cultured at 37° C. 5% CO2 for 2 hours. Cells were pelleted and resuspended for 10 minutes with Live Dead (Near-IR, Thermo Fisher) and washed once in FACS Buffer (PBS/2% FCS/1 mM EDTA). Uptake was measured as percent of live macrophages that are also pHrodo+ by flow cytometry (NovoCyte ACEA, Agilent). Data were analyzed in FlowJo software (TreeStar).

CDC

Raji target cells at a density of $2\text{-}3\times10^4$ per well were plated in 96-well plates and titrated test antibody was added 10 minutes before adding human serum (Sigma) to 25% final. After a 2-hour culture at 37° C. 5% $CO_2$, cell viability was assessed with CellTiter-Glo (Promega), and bioluminescent ATP was read (SpectraMax iD3]) according to the manufacturer's recommendations. Percent CDC activity was calculated as follows: 100×(1−(treated sample/untreated sample)) calculated from relative luciferase unit (RLU) of 1% Triton-X treated samples for 15 minutes as 100% lysis and RLU of Untreated wells as 0% lysis.

In Vivo Study in Cynomolgus Monkeys

In vivo effects of HB2198 on B cell depletion were evaluated after a single IV infusion of 0.2, 1, 5 or 25 mg/kg and after a repeated dose of 25 mg/kg (on Days 0 and 14) in cynomolgus monkeys (*Macaca fascicularis*). Two or four age- and sex-matched animals per dose group were administered using one-hour infusions in the single and repeat dose groups, respectively. Animals were monitored and blood collected for immunophenotyping for 90 days. For blood count, whole blood was collected in EDTA tube and complete blood count (CBC) run on Beckman Coulter DX H600 Hematology analyzer. Flow cytometry of whole blood was performed as previously described to monitor the number of B lymphocytes in absence of CD20 as CD40+ CD3− NKG2A− CD14− CD56− cells. All work was performed under study protocols reviewed and approved by University of Louisiana Lafayette's animal Care and Use Committee (IACUC) and in accordance with regulation of USDA animal welfare Act (CFR 9 section 1,2,3).

Statistical Analysis

Statistical analyses were performed using GraphPad Prism (San Diego, California USA, www.graphpad.com). Statistical significance was determined by ordinary one-way ANOVA with Tukey's multiple comparisons post-test.

Serum Stability

HB2198 was diluted from a stock at 2.53 mg/mL to 25 μg/mL (1/101.2-fold dilution) into PBS containing 1% BSA (PBS/BSA) or normal human serum ( ) in a volume of 250 μL in screw cap tubes. A time zero 25 L sample was transferred to a PCR tube in a −80° C. freezer prior to placing screw cap tubes in a 37° C. tissue culture incubator. At 1.5, 3, 5, and 7 days, 25 μL samples were transferred to PCR tubes at −80° C. Samples were analyzed for HB2198 by capture on CD19-mouse Fc coated plates and detection with an HRP-conjugated anti-rituximab idiotype antibody followed by TMB colorimetric detection. Appropriate dilutions were run, and concentrations were determined from an HB2198 standard curve generated using a 4-parameter logistic equation. Stability was expressed as % activity remaining compared to time zero samples. ADCC Reporter Assay For ADCC reporter assay, Jurkat-FcγRIIIa-158V expressing Luciferase reporter cells were thawed and used per manufacturer's instructions (Promega). Briefly, 1e4 RAJI target cells were cultured in flat bottom luminescent plates with test antibody titration in triplicate 10 minutes prior to addition of FcγR effector cells at 3:1 ratio. Cells were then co-cultured for 5 hours @37° C. Cells and reagents were brought to room temperature and 50 uL Bright-Glo Luciferase added to wells and signal read on SpectraMax plate reader. Data is graphed as Relative Luciferase Units (RLU) as triplicate mean±SD are in Prism with 4-parameter nonlinear regression and EC50 and Emax reported.

Example 34—Fc Gamma Receptor Monovalent Binding by Tetravalent, Bispecific Tetrahedral Antibodies Comprising Two Distinct Fabs that Specifically Bind CD19 and CD20, and Two Fc domains having the S239D/I332E Fc Gamma Receptor Enhancing Mutations Monovalent binding affinities of tetrahedral antibodies to recombinant human Fc gamma receptor proteins (Table 91 and Table 92) were determined by surface plasmon resonance using a Carterra LSA instrument (Carterra, Walnut Creek, CA) (Table 91 and Table 92). The 21-74 tetrahedral antibody with dual wild-type Fc domains (Table 54) and 21-98 tetrahedral antibody with dual Fc domains having the S239/I332E enhancing mutation (Table 54), were compared against the wild-type parent antibodies, Rituximab (MabThera) (Roche, Basel, Switzerland), and FMC59 (huFMC63) (21-101, Table 54), as well as three antibodies having the S239D/I332E mutation, Rituximab-S239D/I332E (21-20, Table 54), FMC59-S239D/I332E (huFMC63-s239D/I332E) (21-102, Table 54), and Tafasitamab-cxix (Tafasitamab-S239E/I332E) (22-02, Table 58). Tables 84 and 85 show that the monovalent binding affinity of the S239/I332E-enhanced 21-98 tetrahedral antibody was comparable to those of the S239D/I332E-enhanced Rituximab and FMC59 antibodies. Similarly, the monovalent binding affinity of the wild-type 21-74 tetrahedral antibody was comparable to those of the wild-type Rituximab and FMC59 parent antibodies. Significantly, the S239/I332E-enhanced 21-98 tetrahedral antibody and S239D/I332E-enhanced Rituximab and FMC59 antibodies consistently demonstrated greater monovalent affinities to Fc gamma receptors than that demonstrated by their wild-type 21-74, Rituximab, and FMC59 counterparts.

Monovalent Fc gamma receptor binding studies were carried out using a capture technique in which antibodies or tetrahedral antibodies are immobilized using a CaptureSelect Biotin Anti-IgG-$CH_1$ conjugate which is covalently bound to the HC30M chip via amine coupling. Recombinant human Fc gamma receptor proteins CD16a-158F (Catalog No. CDA-H5220), CD16a-158V (Catalog No. CD8-H52H4), CD16b (Catalog No. CDB-H5222), CD32a-167H (Catalog No. CD1-H5223), CD32a-167R (Catalog No. CDA-H5221), CD32b/c (Catalog No. CDB-H5228), and CD64 (Catalog. No. FCA-H52H1) (Acro Biosystems, Newark, Delaware) were buffer exchanged using Zeba columns with HEPES running buffer (10 mM HEPES, 150 mM NaCl, 3 mM EDTA, 0.005% Tween-20, pH 7.4 with 0.05 mg/ml BSA), diluted to the desired maximum concentration in Hepes running buffer, followed by 2-fold serial dilutions. Capture kinetic of Fc gamma receptors was carried out in HEPES running buffer during capture kinetic. For capture kinetic, the antibodies and tetrahedral antibodies were injected at 5 μg/mL for 10 minutes to attain a surface density on the chip of 1500 RU. During each injection cycle of a given receptor, only one receptor concentration was injected onto the chip, starting from the lowest concentration and continuing to the highest concentration. Each Fc gamma receptor was allowed to remain on the chip for 5 minutes during the association phase, followed by the injection of HEPES running buffer for an additional 10 minutes during dissociation phase. After each injection round, the chip was regenerated by flowing 0.425% phosphoric acid, three times at one-minute intervals.

Example 35—Fc Gamma Receptor Bivalent Binding by Tetravalent, Bispecific Tetrahedral Antibodies Comprising Two Distinct Fabs that Specifically Bind CD19 and CD20, and Two Fc Domains Having the S239D/I332E Fc Gamma Receptor Enhancing Mutations Bivalent binding affinities of tetrahedral antibodies to cell surface human Fc gamma receptor proteins (FIG. 108) were determined by whole cell binding studies using Chinese Hamster Ovary (CHO) cell lines expressing individual recombinant human Fc gamma receptors, CHO-K1/CD16a-158F (Catalog No. M00586), CHO-K1/CD16a-158V (Catalog No. M00597), CHO-K1/CD16b NA1 (Catalog No. M00602), CHO-K1/CD32a-131H (Catalog No. M00598), CHO-K1/CD32b-232Thr (Catalog No. M00600), CHO-K1/CD32C-13Gln (Catalog No. 601) and CHO-K1/CD64 (Catalog. No. 588) (Genscript, Piscataway, New Jersey). The 21-74 tetrahedral antibody with dual wild-type Fc domains (Table 54) and 21-98 tetrahedral antibody with dual Fc domains having the S239/I332E enhancing mutation (Table 54), were compared against the wild-type parent antibodies, Rituximab (MabThera) (Roche, Basel, Switzerland), and FMC59 (huFMC63) (21-101, Table 54), as well as three antibodies having the S239D/I332E mutation, Rituximab-S239D/I332E (21-20, Table 54), FMC59-S239D/I332E (huFMC63-s239D/I332E) (21-102, Table 54), and Tafasitamab-cxix (Tafasitamab-S239E/I332E) (22-02, Table 58).

Fc-receptor-expressing CHO cells were cultured Ham's F-12K cultured medium, 10% FBS, according to the manufacturer recommendations, using a combination of Puromycin and Hygromycin B specific for each cell line. For binding analysis, cells were trypsinized, counted, and resuspended in Wash buffer (0.3% of BSA in PBS) at a concentration of 6.25x105 cells/ml. Cells (2.5x104/well) were plated in V-bottom plates. Tetrahedral antibodies and parent antibodies were added at a final concentration of 100 nM, and at 1:5 serial dilutions thereof. Cells were then incubated

TABLE 91

| | | CD16a-158F | | CD16a-158V | | CD16b | |
|---|---|---|---|---|---|---|---|
| Protein | Type | $k_D$ (M) | Fold | $k_D$ (M) | Fold | $k_D$ (M) | Fold |
| Rituximab (MabThera) | Antibody | 1.52E−06 | 1.0 | 3.09E−07 | 1.0 | 4.32E−06 | 1.0 |
| FMC59 (huFMC63) | Antibody | 1.56E−06 | 1.0 | 3.16E−07 | 1.0 | 3.67E−06 | 1.2 |
| Rituximab-S239D/1332E | Antibody | 1.76E−08 | 86.6 | 4.33E−09 | 71.3 | 6.68E−08 | 64.8 |
| huFMC63-S239D/1332E | Antibody | 1.72E−08 | 88.3 | 4.53E−09 | 68.1 | 8.63E−08 | 50.1 |
| Tafasitamab-S239D/1332E | Antibody | 1.53E−08 | 99.5 | 4.19E−09 | 73.7 | 6.21E−08 | 69.6 |
| HB2174 (wild-type) | Tetrahedral Antibody | 2.31E−06 | 0.7 | 4.97E−07 | 0.6 | 8.91E−06 | 0.5 |
| HB2198 (S239D/1332E) | Tetrahedral Antibody | 1.57E−08 | 96.9 | 4.19E−09 | 73.7 | 9.50E−08 | 45.5 |

TABLE 92

| | | CD32a-131R | | CD32b/c | | CD64 | |
|---|---|---|---|---|---|---|---|
| Protein | Type | $k_D$ (M) | Fold | $k_D$ (M) | Fold | $k_D$ (M) | Fold |
| Rituximab (MabThera) | Antibody | 6.35E−07 | 1.0 | 8.88E−06 | 1.0 | 5.47E−11 | 1.0 |
| FMC59 (huFMC63) | Antibody | 7.09E−07 | 0.9 | 4.08E−06 | 2.2 | 9.90E−11 | 0.6 |
| Rituximab-S239D/1332E | Antibody | 7.68E−08 | 8.3 | 1.38E−07 | 64.1 | 2.66E−11 | 2.1 |
| huFMC63-S239D/1332E | Antibody | 9.76E−08 | 6.5 | 2.05E−07 | 43.4 | <2.00E−11 | >2.7 |
| Tafasitamab-S239D/1332E | Antibody | 3.91E−08 | 16.2 | 9.94E−08 | 89.3 | <2.00E−11 | >2.7 |
| HB2174 (wild-type) | Tetrahedral Antibody | 9.01E−07 | 0.7 | 4.48E−06 | 2.0 | 1.18E−10 | 0.5 |
| HB2198 (S239D/1332E) | Tetrahedral Antibody | 1.28E−07 | 5.0 | 2.83E−07 | 31.4 | <2.00E−11 | >2.7 |

for 30' on ice, washed twice, and stained using 10 mcg/mL of Goat F(ab')2 Anti-Human Kappa-FITC (Catalog No. 2062-02) (Southern Biotech, Birmingham, Alabama) for 30' on ice, protected from light. Cells were then washed twice, stained for dead cells with Live/Dead fixable dead cell stain (Catalog No. L10119) (Thermo Fisher, Waltham, Massachusetts), and then fixed with BD Cytofix™ Fixation Buffer (Catalog No. 554655) (BD Bioscience, Franklin Lakes, New Jersey). The amount of Goat F(ab')2 Anti-Human Kappa-FITC bound to the tested compounds was assessed by flow cytometry using an Agilent Acea Novocyte Flow Cytometer Model 2000R for CD16a-158F and CD64 and Model 3005 for all other receptors (Agilent, Santa Clara, California). Cells were gated for live single cells. Mean fluorescent intensity values were acquired and plotted against the compound concentrations.

REFERENCES

1) Capon, D. J. et al. Designing CD4 immunoadhesins for AIDS therapy. *Nature* 337, 525-31 (1989). doi: 10.1038/337525a0
2) Chan, K. K. et al. Engineering human ACE2 to optimize binding to the spike protein of SARS coronavirus 2. *Science* 369, 1261-1265 (2020). doi: 10.1126/science-.abc0870
3) Glasgow, A. et al. Engineered ACE2 receptor traps potently neutralize SARS-CoV-2. *Proc Natl Acad Sci* 117, 28046-28055 (2020). doi: 10.1073/pnas.2016093117
4) Li, Y. et al. SARS-CoV-2 and Three Related Coronaviruses Utilize Multiple ACE2 Orthologs and Are Potently Blocked by an Improved ACE2-Ig. *J Virol* 94, e01283-20 (2020). doi: 10.1128/JVI.01283-20
5) Linsky, T. W. et al. De novo design of potent and resilient hACE2 decoys to neutralize SARS-CoV-2. *Science* 370, 1208-1214 (2020). doi: 10.1126/science.abe0075
6) Levy, E. D. et al. 3D complex: a structural classification of protein complexes. *PLOS Comput Biol.* 2, e155 (2006). doi: 10.1371/journal.pcbi.0020155
7) Ahnert, S. E. et al. Principles of assembly reveal a periodic table of protein complexes. *Science* 350, aaa2245 (2015). doi: 10.1126/science.aaa2245
8) Poglitsch, M. et al. Recombinant Expression and Characterization of Human and Murine ACE2: Species-Specific Activation of the Alternative Renin-Angiotensin-System. *Int J Hypertens* 2012, 428950 (2012). doi: 10.1155/2012/428950
9) Schuster M., et al., inventors; Apeiron Biologics AG, assignee. Recombinant ACE2 Polypeptide Dimer, U.S. Pat. No. 8,586,319 B2 (2013).
10) Yan, R. et al. Structural basis for the recognition of SARS-CoV-2 by full-length human ACE2. *Science* 367, 1444-1448 (2020). doi: 10.1126/science.abb2762
11) Troitskaya, L. et al. Mouse antibodies with activity against the SARS-CoV-2 D614G and B.1.351 variants. bioRxiv 2021.07.05.451203 [Preprint]. 7 Jul. 2021. https://doi.org/10.1101/2021.07.05.451203
12) Chan, J. F. et al. Simulation of the Clinical and Pathological Manifestations of Coronavirus Disease 2019 (COVID-19) in a Golden Syrian Hamster Model: Implications for Disease Pathogenesis and Transmissibility. *Clin Infect Dis* 71, 2428-2446 (2020). doi: 10.1093/cid/ciaa325
13) Baum, A. et al. Antibody cocktail to SARS-CoV-2 spike protein prevents rapid mutational escape seen with individual antibodies. *Science* 369, 1014-1018 (2020). doi: 10.1126/science.abd0831
14) Jones, B. E. et al. The neutralizing antibody, LY-CoV555, protects against SARS-CoV-2 infection in non-human primates. *Sci. Transl. Med.* 13, eabf1906 (2021). doi: 10.1126/scitranslmed.abf1906
15) Shi, R. et al. A human neutralizing antibody targets the receptor-binding site of SARS-CoV-2. *Nature* 584, 120-124 (2020). doi: 10.1038/s41586-020-2381-y
16) Zost, S. J. et al. Potently neutralizing and protective human antibodies against SARS-CoV-2. *Nature* 584, 443-449 (2020). doi: 10.1038/s41586-020-2548-6
17) Pinto, D. et al. Cross-neutralization of SARS-CoV-2 by a human monoclonal SARS-COV antibody. *Nature* 583, 290-295 (2020). doi: 10.1038/s41586-020-2349-y
18) Kim, C. et al. A therapeutic neutralizing antibody targeting receptor binding domain of SARS-CoV-2 spike protein. *Nat Commun.* 12, 288 (2021). doi: 10.1038/s41467-020-20602-5
19) Avery, L. B. et al. Utility of a human FcRn transgenic mouse model in drug discovery for early assessment and prediction of human pharmacokinetics of monoclonal antibodies. *MAbs* 8, 1064-78 (2016). doi: 10.1080/19420862.2016.1193660
20) Haschke, M. et al. Pharmacokinetics and pharmacodynamics of recombinant human angiotensin-converting enzyme 2 in healthy human subjects. *Clin Pharmacokinet* 52, 783-92 (2013). doi: 10.1007/s40262-013-0072-7
21) Smith, M. Rituximab (monoclonal anti-CD20 antibody): mechanisms of action and resistance. *Oncogene* 22, 7359-7368 (2003). doi: 10.1038/sj.onc.1206939
22) Spiegel, J. Y. et al. CAR T cells with dual targeting of CD19 and CD22 in adult patients with recurrent or refractory B cell malignancies: a phase 1 trial. *Nat Med* 27, 1419-1431 (2021). doi: 10.1038/s41591-021-01436-0
23) Reff, M. E. et al. Depletion of B cells in vivo by a chimeric mouse human monoclonal antibody to CD20. *Blood* 83, 435-45 (1994). doi: 10.1182/blood.V83.2.435.435
24) Zola, H. et al. Preparation and characterization of a chimeric CD19 monoclonal antibody. *Immunol Cell Biol* 69, 411-22 (1991). doi: 10.1038/icb. 1991.58
25) Chan, A. C. and Carter, P. J. Therapeutic antibodies for autoimmunity and inflammation. Nature Reviews Immunology 10, 301-316 (2010). doi: 10.1038/nri2761
26) Shajahan, A. et al. Comprehensive characterization of N- and O-glycosylation of SARS-CoV-2 human receptor angiotensin converting enzyme 2. *Glycobiology* 31, 410-424 (2021). doi: 10.1093/glycob/cwaa101 M
27) S. E. McGettigan, G. F. Debes, Immunoregulation by antibody secreting cells in inflammation, infection, and cancer. Immunol Rev 303, 103-118 (2021).
28) C. M. Laumont, A. C. Banville, M. Gilardi, D. P. Hollern, B. H. Nelson, Tumour-infiltrating B cells: immunological mechanisms, clinical impact and therapeutic opportunities. Nat Rev Cancer 22, 414-430 (2022).
29) P. A. Blair, L. Y. Norena, F. Flores-Borja, D. J. Rawlings, D. A. Isenberg, M. R. Ehrenstein, C. Mauri, CD19 (+) CD24 (hi) CD38 (hi) B cells exhibit regulatory capacity in healthy individuals but are functionally impaired in systemic Lupus Erythematosus patients. Immunity 32, 129-140 (2010).
30) E. R. Zacca, L. I. Onofrio, C. D. V. Acosta, P. V. Ferrero, S. M. Alonso, M. C. Ramello, E. Mussano, L. Onetti, Cadile, II, M. I. Stancich, M. C. Taboada Bonfanti, C. L. Montes, E. V. Acosta Rodriguez, A. Gruppi, PD-L1 (+) Regulatory B Cells Are Significantly Decreased in Rheumatoid Arthritis Patients and Increase After Successful Treatment. Front Immunol 9, 2241 (2018).

31) S. G. Papageorgiou, T. P. Thomopoulos, A. Liaskas, T. P. Vassilakopoulos, Monoclonal Antibodies in the Treatment of Diffuse Large B-Cell Lymphoma: Moving beyond Rituximab. Cancers (Basel) 14, (2022).
32) I. Abeles, C. Palma, N. Meednu, A. S. Payne, R. J. Looney, J. H. Anolik, B Cell-Directed Therapy in Autoimmunity. Annu Rev Immunol 42, 103-126 (2024).
33) T. G. Forsthuber, D. M. Cimbora, J. N. Ratchford, E. Katz, O. Stuve, B cell-based therapies in CNS autoimmunity: differentiating CD19 and CD20 as therapeutic targets. Ther Adv Neurol Disord 11, 1756286418761697 (2018).
34) J. Duell, K. J. Maddocks, E. Gonzalez-*Barca*, W. Jurczak, A. M. Liberati, S. De Vos, Z. Nagy, A. Obr, G. Gaidano, P. Abrisqueta, N. Kalakonda, M. Andre, M. Dreyling, T. Menne, O. Tournilhac, M. Augustin, A. Rosenwald, M. Dirnberger-Hertweck, J. Weirather, S. Ambarkhane, G. Salles, Long-term outcomes from the Phase II L-MIND study of tafasitamab (MOR208) plus lenalidomide in patients with relapsed or refractory diffuse large B-cell lymphoma. Haematologica 106, 2417-2426 (2021).
35) B. A. C. Cree, J. L. Bennett, H. J. Kim, B. G. Weinshenker, S. J. Pittock, D. M. Wingerchuk, K. Fujihara, F. Paul, G. R. Cutter, R. Marignier, A. J. Green, O. Aktas, H. P. Hartung, F. D. Lublin, J. Drappa, G. Barron, S. Madani, J. N. Ratchford, D. She, D. Cimbora, E. Katz, N. M. s. investigators, Inebilizumab for the treatment of neuromyelitis optica spectrum disorder (N-MOmentum): a double-blind, randomised placebo-controlled phase 2/3 trial. Lancet 394, 1352-1363 (2019).
36) J. Y. Spiegel, S. Patel, L. Muffly, N. M. Hossain, J. Oak, J. H. Baird, M. J. Frank, P. Shiraz, B. Sahaf, J. Craig, M. Iglesias, S. Younes, Y. Natkunam, M. G. Ozawa, E. Yang, J. Tamaresis, H. Chinnasamy, Z. Ehlinger, W. Reynolds, R. Lynn, M. C. Rotiroti, N. Gkitsas, S. Arai, L. Johnston, R. Lowsky, R. G. Majzner, E. Meyer, R. S. Negrin, A. R. Rezvani, S. Sidana, J. Shizuru, W. K. Weng, C. Mullins, A. Jacob, I. Kirsch, M. Bazzano, J. Zhou, S. Mackay, S. J. Bornheimer, L. Schultz, S. Ramakrishna, K. L. Davis, K. A. Kong, N. N. Shah, H. Qin, T. Fry, S. Feldman, C. L. Mackall, D. B. Miklos, CAR T cells with dual targeting of CD19 and CD22 in adult patients with recurrent or refractory B cell malignancies: a phase 1 trial. Nat Med 27, 1419-1431 (2021).
37) A. Mackensen, F. Muller, D. Mougiakakos, S. Boltz, A. Wilhelm, M. Aigner, S. Volkl, D. Simon, A. Kleyer, L. Munoz, S. Kretschmann, S. Kharboutli, R. Gary, H. Reimann, W. Rosler, S. Uderhardt, H. Bang, M. Herrmann, A. B. Ekici, C. Buettner, K. M. Habenicht, T. H. Winkler, G. Kronke, G. Schett, Anti-CD19 CAR T cell therapy for refractory systemic lupus erythematosus. Nat Med 28, 2124-2132 (2022).
38) F. Muller, J. Taubmann, L. Bucci, A. Wilhelm, C. Bergmann, S. Volkl, M. Aigner, T. Rothe, I. Minopoulou, C. Tur, J. Knitza, S. Kharboutli, S. Kretschmann, I. Vasova, S. Spoerl, H. Reimann, L. Munoz, R. G. Gerlach, S. Schafer, R. Grieshaber-Bouyer, A. S. Korganow, D. Farge-Bancel, D. Mougiakakos, A. Bozec, T. Winkler, G. Kronke, A. Mackensen, G. Schett, CD19 CAR T-Cell Therapy in Autoimmune Disease-A Case Series with Follow-up. N Engl J Med 390, 687-700 (2024).
39) L. Bucci, M. Hagen, T. Rothe, M. G. Raimondo, F. Fagni, C. Tur, A. Wirsching, J. Wacker, A. Wilhelm, J. P. Auger, M. Pachowsky, M. Eckstein, S. Alivernini, A. Zoli, G. Kronke, S. Uderhardt, A. Bozec, M. A. D'Agostino, G. Schett, R. Grieshaber-Bouyer, Bispecific T cell engager therapy for refractory rheumatoid arthritis. Nat Med 30, 1593-1601 (2024).
40) G. A. Lazar, W. Dang, S. Karki, O. Vafa, J. S. Peng, L. Hyun, C. Chan, H. S. Chung, A. Eivazi, S. C. Yoder, J. Vielmetter, D. F. Carmichael, R. J. Hayes, B. I. Dahiyat, Engineered antibody Fc variants with enhanced effector function. Proc Natl Acad Sci USA 103, 4005-4010 (2006).
41) J. Zalevsky, I. W. Leung, S. Karki, S. Y. Chu, E. A. Zhukovsky, J. R. Desjarlais, D. F. Carmichael, C. E. Lawrence, The impact of Fc engineering on an anti-CD19 antibody: increased Fcgamma receptor affinity enhances B-cell clearing in nonhuman primates. Blood 113, 3735-3743 (2009).
42) E. Mossner, P. Brunker, S. Moser, U. Puntener, C. Schmidt, S. Herter, R. Grau, C. Gerdes, A. Nopora, E. van Puijenbroek, C. Ferrara, P. Sondermann, C. Jager, P. Strein, G. Fertig, T. Friess, C. Schull, S. Bauer, J. Dal Porto, C. Del Nagro, K. Dabbagh, M. J. Dyer, S. Poppema, C. Klein, P. Umana, Increasing the efficacy of CD20 antibody therapy through the engineering of a new type II anti-CD20 antibody with enhanced direct and immune effector cell-mediated B-cell cytotoxicity. Blood 115, 4393-4402 (2010).
43) D. J. Capon, L. Troitskaya, N. L. S. Chan, M. Fomin, U. Edman, B. Frank, J. Jin, R. Martinelli, B. Z. Capon, G. A. Ferguson, M. L. Gefter, G. Simmons, Topologically engineered antibodies and Fc-fusion proteins: a new class of multifunctional therapeutic candidates for SARS-CoV-2, cancer, and other disease. bioRxiv doi: 10.1101/2022.03.23.485397, (2022).
44) R. Yan, Y. Zhang, Y. Li, L. Xia, Y. Guo, Q. Zhou, Structural basis for the recognition of SARS-CoV-2 by full-length human ACE2. Science 367, 1444-1448 (2020).
45) X. Gan, Q. Shan, H. Li, R. Janssens, Y. Shen, Y. He, F. Chen, R. van Haperen, D. Drabek, J. Li, Y. Zhang, J. Zhao, B. Qin, M. J. Jheng, V. Chen, J. Wang, Y. Rong, F. Grosveld, An anti-CTLA-4 heavy chain-only antibody with enhanced T (reg) depletion shows excellent preclinical efficacy and safety profile. Proc Natl Acad Sci USA 119, e2200879119 (2022).
46) A. M. Ryan, S. A. Sokolowski, C. K. Ng, N. Shirai, M. Collinge, A. C. Shen, J. Arrington, Z. Radi, T. R. Cummings, S. A. Ploch, S. A. Stephenson, N. K. Tripathi, S. I. Hurst, G. L. Finch, M. W. Leach, Comparative nonclinical assessments of the proposed biosimilar PF-05280586 and rituximab (MabThera (R)). Toxicol Pathol 42, 1069-1081 (2014).
47) R. A. Furie, G. Aroca, M. D. Cascino, J. P. Garg, B. H. Rovin, A. Alvarez, H. Fragoso-Loyo, E. Zuta-Santillan, T. Schindler, P. Brunetta, C. M. Looney, I. Hassan, A. Malvar, B-cell depletion with obinutuzumab for the treatment of proliferative lupus nephritis: a randomised, double-blind, placebo-controlled trial. Ann Rheum Dis 81, 100-107 (2022).
48) F. Muller, A. Mackensen, G. Schett, CAR T-Cell Therapy in Autoimmune Disease. Reply. N Engl J Med 390, 1631-1632 (2024).
49) V. Reddy, G. Cambridge, D. A. Isenberg, M. J. Glennie, M. S. Cragg, M. Leandro, Internalization of rituximab and the efficiency of B Cell depletion in rheumatoid arthritis and systemic lupus erythematosus. Arthritis Rheumatol 67, 2046-2055 (2015).
50) J. Uchida, Y. Hamaguchi, J. A. Oliver, J. V. Ravetch, J. C. Poe, K. M. Haas, T. F. Tedder, The innate mononuclear phagocyte network depletes B lymphocytes through Fc receptor-dependent mechanisms during anti-CD20 antibody immunotherapy. J Exp Med 199, 1659-1669 (2004).

51) D. M. Schewe, A. Alsadeq, C. Sattler, L. Lenk, F. Vogiatzi, G. Cario, S. Vieth, T. Valerius, S. Rosskopf, F. Meyersieck, J. Alten, M. Schrappe, M. Gramatzki, M. Peipp, C. Kellner, An Fc-engineered CD19 antibody eradicates MRD in patient-derived MLL-rearranged acute lymphoblastic leukemia xenografts. Blood 130, 1543-1552 (2017).

52) R. Herbst, Y. Wang, S. Gallagher, N. Mittereder, E. Kuta, M. Damschroder, R. Woods, D. C. Rowe, L. Cheng, K. Cook, K. Evans, G. P. Sims, D. S. Pfarr, M. A. Bowen, W. Dall'Acqua, M. Shlomchik, T. F. Tedder, P. Kiener, B. Jallal, H. Wu, A. J. Coyle, B-cell depletion in vitro and in vivo with an afucosylated anti-CD19 antibody. J Pharmacol Exp Ther 335, 213-222 (2010).

53) C. W. Bruggeman, J. Houtzager, B. Dierdorp, J. Kers, S. T. Pals, R. Lutter, T. van Gulik, J. M. M. den Haan, T. K. van den Berg, R. van Bruggen, T. W. Kuijpers, Tissue-specific expression of IgG receptors by human macrophages ex vivo. PLOS One 14, e0223264 (2019).

54) S. Herter, M. C. Birk, C. Klein, C. Gerdes, P. Umana, M. Bacac, Glycoengineering of therapeutic antibodies enhances monocyte/macrophage-mediated phagocytosis and cytotoxicity. J Immunol 192, 2252-2260 (2014).

55) A. Gonzalez-Quintela, R. Alende, F. Gude, J. Campos, J. Rey, L. M. Meijide, C. Fernandez-Merino, C. Vidal, Serum levels of immunoglobulins (IgG, IgA, IgM) in a general adult population and their relationship with alcohol consumption, smoking and common metabolic abnormalities. Clin Exp Immunol 151, 42-50 (2008).

56) H. M. Horton, M. J. Bernett, E. Pong, M. Peipp, S. Karki, S. Y. Chu, J. O. Richards, I. Vostiar, P. F. Joyce, R. Repp, J. R. Desjarlais, E. A. Zhukovsky, Potent in vitro and in vivo activity of an Fc-engineered anti-CD19 monoclonal antibody against lymphoma and leukemia. Cancer Res 68, 8049-8057 (2008).

57) M. Constantinides, A. Fayd'herbe De Maudave, M. Potier-Cartereau, M. Campos-Mora, G. Cartron, M. Villalba, Direct Cell Death Induced by CD20 Monoclonal Antibodies on B Cell Lymphoma Cells Revealed by New Protocols of Analysis. Cancers (Basel) 15, (2023).

58) M. G. Derebe, R. K. Nanjunda, G. L. Gilliland, E. R. Lacy, M. L. Chiu, Human IgG subclass cross-species reactivity to mouse and cynomolgus monkey Fcgamma receptors. Immunol Lett 197, 1-8 (2018).

59) A. W. Boesch, A. R. Miles, Y. N. Chan, N. Y. Osei-Owusu, M. E. Ackerman, IgG Fc variant cross-reactivity between human and rhesus macaque FcgammaRs. MAbs 9, 455-465 (2017).

60) Q. Wang, Y. Chen, M. Pelletier, R. Cvitkovic, J. Bonnell, C. Y. Chang, A. C. Koksal, E. O'Connor, X. Gao, X. Q. Yu, H. Wu, C. K. Stover, W. F. Dall'Acqua, X. Xiao, Enhancement of antibody functions through Fc multiplications. MAbs 9, 393-403 (2017).

61) H. Nagashima, T. Tezuka, W. Tsuchida, H. Maeda, J. Kohroki, Y. Masuho, Tandemly repeated Fc domain augments binding avidities of antibodies for Fcgamma receptors, resulting in enhanced antibody-dependent cellular cytotoxicity. Mol Immunol 45, 2752-2763 (2008).

62) H. Nagashima, M. Ootsubo, M. Fukazawa, S. Motoi, S. Konakahara, Y. Masuho, Enhanced antibody-dependent cellular phagocytosis by chimeric monoclonal antibodies with tandemly repeated Fc domains. J Biosci Bioeng 111, 391-396 (2011).

63) B. Hervier, V. Beziat, J. Haroche, A. Mathian, P. Lebon, P. Ghillani-Dalbin, L. Musset, P. Debre, Z. Amoura, V. Vieillard, Phenotype and function of natural killer cells in systemic lupus erythematosus: excess interferon-gamma production in patients with active disease. Arthritis Rheum 63, 1698-1706 (2011).

64) J. Ochs, N. Nissimov, S. Torke, M. Freier, K. Grondey, J. Koch, M. Klein, L. Feldmann, C. Gudd, T. Bopp, S. Hausser-Kinzel, M. S. Weber, Proinflammatory CD20 (+) T cells contribute to CNS-directed autoimmunity. Sci Transl Med 14, eabi4632 (2022).

65) E. Wilk, T. Witte, N. Marquardt, T. Horvath, K. Kalippke, K. Scholz, N. Wilke, R. E. Schmidt, R. Jacobs, Depletion of functionally active CD20+ T cells by rituximab treatment. Arthritis Rheum 60, 3563-3571 (2009).

66) A. Palanichamy, S. Jahn, D. Nickles, M. Derstine, A. Abounasr, S. L. Hauser, S. E. Baranzini, D. Leppert, H. C. von Budingen, Rituximab efficiently depletes increased CD20-expressing T cells in multiple sclerosis patients. J Immunol 193, 580-586 (2014).

67) J. Hiraga, A. Tomita, T. Sugimoto, K. Shimada, M. Ito, S. Nakamura, H. Kiyoi, T. Kinoshita, T. Naoe, Down-regulation of CD20 expression in B-cell lymphoma cells after treatment with rituximab-containing combination chemotherapies: its prevalence and clinical significance. Blood 113, 4885-4893 (2009).

68) R. G. Majzner, C. L. Mackall, Tumor Antigen Escape from CAR T-cell Therapy. Cancer Discov 8, 1219-1226 (2018).

69) M. Akkaya, K. Kwak, S. K. Pierce, B cell memory: building two walls of protection against pathogens. Nat Rev Immunol 20, 229-238 (2020).

70) E. M. Vital, S. Dass, M. H. Buch, K. Henshaw, C. T. Pease, M. F. Martin, F. Ponchel, A. C. Rawstron, P. Emery, B cell biomarkers of rituximab responses in systemic lupus erythematosus. Arthritis Rheum 63, 3038-3047 (2011).

71) C. Ruetsch-Chelli, S. Bresch, B. Seitz-Polski, A. Rosenthal, C. Desnuelle, M. Cohen, V. Brglez, M. Ticchioni, C. Lebrun-Frenay, Memory B Cells Predict Relapse in Rituximab-Treated Myasthenia Gravis. Neurotherapeutics 18, 938-948 (2021).

SEQUENCE LISTING (7847 sequences)

SEQ ID NO: 1 - protein, 213 aa, synthetic construct
  REGION 1..213: note = Rc6; L chain: R1
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2 - protein, 451 aa, synthetic construct
  REGION 1..451: note = Rc6; H chain: Rh
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - protein, 222 aa, synthetic construct
  REGION 1..222: note = Rc6; Fc chain: Fc6CC
CPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4 - protein, 451 aa, synthetic construct
  REGION 1..451: note = Rc6HYRF; H chain: Rh-HYRF
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 5 - protein, 451 aa, synthetic construct; identical to SEQ ID NO: 4
  REGION 1..451: note = Rc60; H chain: Rh-knob

SEQ ID NO: 6 - protein, 222 aa, synthetic construct
  REGION 1..222: note = Rc60; Fc chain: Fc6CC-hole
CPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 7 - protein, 451 aa, synthetic construct
  REGION 1..451: note = Rc66; H chain: Rh-B
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 8 - protein, 222 aa, synthetic construct
  REGION 1..222: note = Rc66; Fc chain: Fc6CC-A
CPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 9 - protein, 451 aa, synthetic construct
  REGION 1..451: note = Rc66SIDE; H chain: Rh-B/SIDE
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 10 - protein, 222 aa, synthetic construct
  REGION 1..222: note = Rc66SIDE; Fc chain: Fc6CC-A/SIDE
CPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 11 - protein, 451 aa, synthetic construct
  REGION 1..451: note = Rc66AAC9; H chain: Rh-B/AAC9
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPKRRGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 12 - protein, 222 aa, synthetic construct
  REGION 1..222: note = Rc66AAC9; H chain: Rh-B/AAC9
CPPCPAPEDEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 13 - protein, 684 aa, synthetic construct
  REGION 1..684: note = Rc66AAC9HA9; H chain: Rh-B/AAC9/HA9h
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPKRRGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGKAAAGGGGSGGGGSEVQLQESGGGLVQPGDSLRLSCAASGFTFSNYWLGWIRQAPGKGPEWVGDIYPGGGYTNYNEKFKGRFTISADTSKNIAYLQVNSLRAEDTAVYYCARSASWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 14 - protein, 452 aa, synthetic construct
  REGION 1..452: note = Rc66AAC9HA9; Fc chain: Fc6CC-A/AAC9/HA91
CPPCPAPEDEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGKAAAGGGGSGGGGSDIELTQSPSSLSASVGDRVTITCRSNTGTVTTSNYASWYQQKPGKAPKGLIGHTNNRAPGVPSRFSGSLSGADATLTISSLQPEDLATYYCALWYNNHWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 455 aa, synthetic construct
  REGION 1..455: note = FcAAC9HA9; H chain: Fc6CC-B/AAC9/HA9h
CPPCPAPKRRGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGKAAAGGGGSGGGGSEVQLQESGGGLVQPGDSLRLSCAASGFTFSNYWLGWIRQAPGKGPEWVGDIYPGGGYTNYNEKFKGRFTISADTSKNIAYLQVNSLRAEDTAVYYCARSASWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 16 - protein, 217 aa, synthetic construct
  REGION 1..217: note = HA9c66AAC9; L chain: HA91
DIELTQSPSSLSASVGDRVTITCRSNTGTVTTSNYASWYQQKPGKAPKGLIGHTNNRAPGVPSRFSGSLSGADATLTISSLQPEDLATYYCALWYNNHWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 447 aa, synthetic construct
  REGION 1..447: note = HA9c66AAC9; H chain: HA9h-B/AAC9
EVQLQESGGGLVQPGDSLRLSCAASGFTFSNYWLGWIRQAPGKGPEWVGDIYPGGGYTNYNEKFKGRFTISADTSKNIAYLQVNSLRAEDTAVYYCARSASWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPKRRGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 18 - protein, 213 aa, synthetic construct
  REGION 1..213: note = HRc66; L chain: HR-1
DIQMTQSPSSLSASVGDRVTITCRASSSVSYIHWYQQKPGKAPKPLIYATSNLASGVPSRFSGSGSGTDFTLTISSLQPEDFATYYCQQWTSNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19 - protein, 451 aa, synthetic construct
  REGION 1..451: note = HRc66; H chain: HRh-B
EVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARSTYYGGDWYFNVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 20 - protein, 218 aa, synthetic construct
  REGION 1..218: note = B19c66; L chain: B19l
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21 - protein, 454 aa, synthetic construct
  REGION 1..454: note = B19c66; H chain: B19h-B
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 22 - protein, 454 aa, synthetic construct
  REGION 1..454: note = B19c66AAC9; H chain: B19h-B/AAC9
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPKRRGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 23 - protein, 733 aa, synthetic construct
  REGION 1..733: note = Blc6AAC9; scFv chain: BlscFvAAC9-B
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKAAAEPKSSDKTHTCPPCPAPKRRGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 24 - protein, 213 aa, synthetic construct
  REGION 1..213: note = Drc66; L chain: Dr1
SELTQDPAVSVALGQTVRITCSGDSLRSYYASWYQQKPGQAPVLVIYGANNRPSGIPDRFSGSSSGNTASLTITGAQAEDEADYYCNSADSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 25 - protein, 451 aa, synthetic construct
  REGION 1..451: note = Drc66; H chain: Drh-B
EVQLVQSGGGVERPGGSLRLSCAASGFTFDDYAMSWVRQAPGKGLEWVSGINWQGGSTGYADSVKGRVTISRDNAKNSLYLQMNSLRAEDTAVYYCAKILGAGRGWYFDYWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 26 - protein, 351 aa, synthetic construct
  REGION 1..351: note = 15c6AAC9; IL-15 chain: IL15-B/AAC9
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPKRRGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 27 - protein, 406 aa, synthetic construct
  REGION 1..406: note = 15Rc6AAC9; IL-15R chain: IL15R-B/AAC9
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGGGGSEPKSSDKTHTCPPCPAPKRRGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 28 - protein, 227 aa, synthetic construct
  REGION 1..227: note = Dc6AAC9; Fc chain: DKTHT-Fc6CC-B/AAC9
DKTHTCPPCPAPKRRGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 29 - protein, 222 aa, synthetic construct
  REGION 1..222: note = Fc6RF; Fc chain: Fc6CC-RF
CPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 30 - protein, 451 aa, synthetic construct
  REGION 1..451: note = RSIDE; H chain: Rh/SIDE
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 31 - protein, 351 aa, synthetic construct
  REGION 1..351: note = 15c6AAC9N79Q; IL-15 chain: IL15-B/AAC/N79Q
NWVNVISDLKKIEDLIQSMHIDATLYTESDVHPSCKVTAMKCFLLELQVISLESGDASIHDTVENLIILANNSLSSNGQVTESGCKECEELEEKNIKEFLQSFVHIVQMFINTSGGGGSEPKSSDKTHTCPPCPAPKRRGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 32 - protein, 220 aa, synthetic construct
  REGION 1..220: note = 6Ec66; L chain: 6E10l
DIVMTQSPSSLTVTAGEKVALTCKASQSLLSSGNQKNYLTWYQQKPGQPPKLLIYWASIRESGVPDRFTGSGSGTFFTLTISSVQAEDLAVYYCQNDYNYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33 - protein, 450 aa, synthetic construct
  REGION 1..450: note = 6Ec66; H chain: 6E10h-B
EVQLQQSGAELVKPGASVKLSCTASGFNIKDTYIHWVKQRPEQGLEWIGRFDPVNVNTRYDSRFRGKATITSDASSNTAYLHLNSLTSEDTAVYYCSRSYYNGRRRFTYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 34 - protein, 450 aa, synthetic construct
  REGION 1..450: note = 6E10; H chain: 6E10h
EVQLQQSGAELVKPGASVKLSCTASGFNIKDTYIHWVKQRPEQGLEWIGRFDPVNVNTRYDSRFRGKATITSDASSNTAYLHLNSLTSEDTAVYYCSRSYYNGRRRFTYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - protein, 219 aa, synthetic construct
  REGION 1..219: note = Soc66; L chain: Sol
DVVMTQSPLSLPVTLGQPASISCRSSQSLIYSDGNAYLHWFLQKPGQSPRLLIYKVSNRFSGVPDRFSGSGSGTDFTLKISRVEAEDVGVYYCSQSTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36 - protein, 442 aa, synthetic construct
  REGION 1..442: note = Soc66; H chain: Soh-B
EVQLVESGGGLVQPGGSLRLSCAASGFTFSRYSMSWVRQAPGKGLELVAQINSVGNSTYYPDTVKGRFTISRDNAKNTLYLQMNSLRAEDTAVYYCASGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 37 - protein, 442 aa, synthetic construct
  REGION 1..442: note = So; H chain: Soh
EVQLVESGGGLVQPGGSLRLSCAASGFTFSRYSMSWVRQAPGKGLELVAQINSVGNSTYYPDTVKGRFTISRDNAKNTLYLQMNSLRAEDTAVYYCASGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - protein, 219 aa, synthetic construct
  REGION 1..219: note = Gl; L1 chain: Gl-L1 (CD20/Vk-Ck)
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 39 - protein, 232 aa, synthetic construct
  REGION 1..232: note = Gl; L2 chain: Gl-L2 (CD3/VH-C-lambda)
EVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 40 - protein, 673 aa, synthetic construct
  REGION 1..673: note = Gl; H1 chain: G1-H1 (CD20/VH-CH1)-(CD3/V-lambda-CH1)
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 41 - protein, 448 aa, synthetic construct
  REGION 1..448: note = G1; H2 chain: G1-H2 (CD20/VH-CH1)
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 42 - protein, 221 aa, synthetic construct
  REGION 1..221: note = FcPG; Fc chain: Fc6CC-hole/PGLALA/delK
CPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 43 - protein, 222 aa, synthetic construct
  REGION 1..222: note = ObSpc60PG; L1 chain Obx-L (CD20/VH-CH1)
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 44 - protein, 216 aa, synthetic construct
  REGION 1..216: note = ObSpc60PG; L2 chain: Sp-L (CD3/V-lambda-C-lambda)
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 45 - protein, 684 aa, synthetic construct
  REGION 1..684: note = ObSpc60PG; H chain: ObSp-H (CD20/Vk-Ck)-(CD3/VH-CH1)
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDGGGGSGGGGSEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 46 - protein, 219 aa, synthetic construct
  REGION 1..219: note = Obc60PG; L chain: Ob-L (CD20/Vk-Ck)
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 47 - protein, 448 aa, synthetic construct
  REGION 1..448: note = Obc60PG; H chain: Ob-H/knob/PGLALA (CD20/VH-CH1)
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 48 - protein, 1266 aa, synthetic construct
  REGION 1..1266: note = ObSp41BBc60PG; H chain: ObSp-H-41BB/knob/PGLALA (CD20/Vk-Ck)-(CD3/VH-CH1)-41BB
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDGGGGSGGGGSEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 49 - protein, 1030 aa, synthetic construct
  REGION 1..1030: note = Ob41BBc60PG; H chain: Ob-H-41BB/knob/PGLALA (CD20/VH-CH1)-41BB
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 50 - protein, 803 aa, synthetic construct
  REGION 1..803: note = ObSpc60PG-41BB-RF; Fc chain: Fc6CC-hole/PGLALA/RF/41BB
CPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 51 - protein, 215 aa, synthetic construct
  REGION 1..215: note = Ci; L1 chain: Ci-L1 (CEA/V-kappa-C-kappa)
DIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 52 - protein, 214 aa, synthetic construct
  REGION 1..214: note = Ci; L2 chain: Ci-L2 (CD3/V-lambda-CH1)
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 53 - protein, 693 aa, synthetic construct
  REGION 1..693: note = Ci; H1 chain: Ci-H1 (CEA/VH-CH1)-(CD3/VH-C-lambda)
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 54 - protein, 450 aa, synthetic construct
  REGION 1..450: note = Ci; H2 chain: Ci-H2 (CEA/VH-CH1)
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 55 - protein, 335 aa, synthetic construct
  REGION 1..335: note = CD3Ec60PG; H chain: CD3-epsilon/knob/PGLALA
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 56 - protein, 394 aa, synthetic construct
  REGION 1..394: note = 41BBc60PG; 4-1BB/knob/PGLALA
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 57 - protein, 394 aa, synthetic construct
  REGION 1..394: note = 41BBFcPG; H chain: 4-1BB/PGLALA
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 58 - protein, 503 aa, synthetic construct
  REGION 1..503: note = CD19c60PG; H chain: CD19/knob/PGLALA
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 59 - protein, 503 aa, synthetic construct
  REGION 1..503: note = CD19FcPG; H chain: CD19/PGLALA
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 60 - protein, 882 aa, synthetic construct
  REGION 1..882: note = CEACAM5c60PG; H chain: CEACAM5/knob/PGLALA
KLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 61 - protein, 882 aa, synthetic construct
  REGION 1..882: note = CEACAM5FcPG; H chain: CEACAM5/PGLALA
KLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 62 - protein, 829 aa, synthetic construct
  REGION 1..829: note = ACE2-615/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 63 - protein, 829 aa, synthetic construct
  REGION 1..829: note = ACE2-615/SSS/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADEPKSSDKTHTSPPSPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 64 - protein, 221 aa, synthetic construct
  REGION 1..221: note = FcPG-CS; Fc chain: Fc6CS-hole/PGLALA/delK
CPPSPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 65 - protein, 954 aa, synthetic construct
  REGION 1..954: note = ACE2-740/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 66 - protein, 1011 aa, synthetic construct
  REGION 1..1011: note = ACE2-740/240/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTPEPSTAPSTSFLLPMGPSPPAEGSTGDEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 67 - protein, 1006 aa, synthetic construct
  REGION 1..1006: note = ACE2-740/235/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTPEPSTAPSTSFLLPMGPSPPAEGSTGDDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 68 - protein, 983 aa, synthetic construct
  REGION 1..983: note = ACE2-740/212/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTPEPSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 69 - protein, 979 aa, synthetic construct
  REGION 1..979: note = ACE2-740/208/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 70 - protein, 969 aa, synthetic construct
  REGION 1..969: note = ACE2-740/198/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 71 - protein, 956 aa, synthetic construct
  REGION 1..956: note = ACE2-740/185/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 72 - protein, 954 aa, synthetic construct; identical to SEQ ID NO: 65
  REGION 1..954: note = ACE2-740/knob/PGLALA/R273Q

SEQ ID NO: 73 - protein, 221 aa, synthetic construct
  REGION 1..221: note = Fc6CC-hole/PGLALA/RF
CPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 74 - protein, 834 aa, synthetic construct
  REGION 1..834: note = ACE2-615/69/Fc/K
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADGGGGAGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 959 aa, synthetic construct
  REGION 1..959: note = ACE2-740/G9/Fc/K
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSGGGGAGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 829 aa, synthetic construct
  REGION 1..829: note = ACE2-615/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 77 - protein, 954 aa, synthetic construct
  REGION 1..954: note = ACE2-740/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 78 - protein, 958 aa, synthetic construct
  REGION 1..958: note = ACE2-740/G9/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSGGGGAGGGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 79 - protein, 958 aa, synthetic construct
  REGION 1..958: note = ACE2-740/G9/PGLALA
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSGGGGAGGGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 80 - protein, 958 aa, synthetic construct
  REGION 1..958: note = ACE2-740/G9/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSGGGGAGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 81 - protein, 958 aa, synthetic construct
  REGION 1..958: note = ACE2-740/G9
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSGGGGAGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 82 - protein, 320 aa, synthetic construct
  REGION 1..320: note = ACE2-106/knob/PGLALA
QSTIEEQAKTFLDKFNHEAEDLFYQSSLASWNYNTNITEENVQNMNNAGDKWSAFLKEQSTLAQMYPLQEIQNLTVKLQLQALQQNGSSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 83 - protein, 320 aa, synthetic construct
  REGION 1..320: note = ACE2-106/PGLALA
QSTIEEQAKTFLDKFNHEAEDLFYQSSLASWNYNTNITEENVQNMNNAGDKWSAFLKEQSTLAQMYPLQEIQNLTVKLQLQALQQNGSSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 84 - protein, 815 aa, synthetic construct
  REGION 1..815: note = ACE2-106x6/knob/PGLALA
QSTIEEQAKTFLDKFNHEAEDLFYQSSLASWNYNTNITEENVQNMNNAGDKWSAFLKEQSTLAQMYPLQEIQNLTVKLQLQALQQNGSSGGGGSGGGGSQSTIEEQAKTFLDKFNHEAEDLFYQSSLASWNYNTNITEENVQNMNNAGDKWSAFLKEQSTLAQMYPLQEIQNLTVKLQLQALQQNGSSGGGGSGGGGSQSTIEEQAKTFLDKFNHEAEDLFYQSSLASWNYNTNITEENVQNMNNAGDKWSAFLKEQSTLAQMYPLQEIQNLTVKLQLQALQQNGSSGGGGSGGGGSQSTIEEQAKTFLDKFNHEAEDLFYQSSLASWNYNTNITEENVQNMNNAGDKWSAFLKEQSTLAQMYPLQEIQNLTVKLQLQALQQNGSSGGGGSGGGGSQSTIEEQAKTFLDKFNHEAEDLFYQSSLASWNYNTNITEENVQNMNNAGDKWSAFLKEQSTLAQMYPLQEIQNLTVKLQLQALQQNGSSGGGGSGGGGSQSTIEEQAKTFLDKFNHEAEDLFYQSSLASWNYNTNITEENVQNMNNAGDKWSAFLKEQSTLAQMYPLQEIQNLTVKLQLQALQQNGSSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 85 - protein, 815 aa, synthetic construct
  REGION 1..815: note = ACE2-106x6/PGLALA
QSTIEEQAKTFLDKFNHEAEDLFYQSSLASWNYNTNITEENVQNMNNAGDKWSAFLKEQSTLAQMYPLQEIQNLTVKLQLQALQQNGSSGGGGSGGGGSQSTIEEQAKTFLDKFNHEAEDLFYQSSLASWNYNTNITEENVQNMNNAGDKWSAFLKEQSTLAQMYPLQEIQNLTVKLQLQALQQNGSSGGGGSGGGGSQSTIEEQAKTFLDKFNHEAEDLFYQSSLASWNYNTNITEENVQNMNNAGDKWSAFLKEQSTLAQMYPLQEIQNLTVKLQLQALQQNGSSGGGGSGGGGSQSTIEEQAKTFLDKFNHEAEDLFYQSSLASWNYNTNITEENVQNMNNAGDKWSAFLKEQSTLAQMYPLQEIQNLTVKLQLQALQQNGSSGGGGSGGGGSQSTIEEQAKTFLDKFNHEAEDLFYQSSLASWNYNTNITEENVQNMNNAGDKWSAFLKEQSTLAQMYPLQEIQNLTVKLQLQALQQNGSSGGGGSGGGGSQSTIEEQAKTFLDKFNHEAEDLFYQSSLASWNYNTNITEENVQNMNNAGDKWSAFLKEQSTLAQMYPLQEIQNLTVKLQLQALQQNGSSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 86 - protein, 899 aa, synthetic construct
  REGION 1..899: note = CoV2-680/knob/PGLALA
SQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 87 - protein, 899 aa, synthetic construct
  REGION 1..899: note = CoV2-680/PGLALA
SQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 88 - protein, 884 aa, synthetic construct
  REGION 1..884: note = SARS-666/knob/PGLALA
SDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 89 - protein, 899 aa, synthetic construct
  REGION 1..899: note = RaTG13-680/knob/PGLALA
SQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 90 - protein, 1006 aa, synthetic construct
  REGION 1..1006: note = ACE2-740/235/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTPEPSTAPSTSFLLPMGPSPPAEGSTGDDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 91 - protein, 983 aa, synthetic construct
  REGION 1..983: note = ACE2-740/212/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTPEPSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 92 - protein, 979 aa, synthetic construct
  REGION 1..979: note = ACE2-740/208/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 93 - protein, 973 aa, synthetic construct
  REGION 1..973: note = ACE2-740/202/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 94 - protein, 972 aa, synthetic construct
  REGION 1..972: note = ACE2-740/201/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 95 - protein, 971 aa, synthetic construct
  REGION 1..971: note = ACE2-740/200/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 96 - protein, 970 aa, synthetic construct
  REGION 1..970: note = ACE2-740/199/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 97 - protein, 969 aa, synthetic construct
  REGION 1..969: note = ACE2-740/198/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 98 - protein, 968 aa, synthetic construct
  REGION 1..968: note = ACE2-740/197/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 99 - protein, 967 aa, synthetic construct
  REGION 1..967: note = ACE2-740/196/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 100 - protein, 966 aa, synthetic construct
  REGION 1..966: note = ACE2-740/196/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 101 - protein, 965 aa, synthetic construct
  REGION 1..965: note = ACE2-740/194/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 102 - protein, 964 aa, synthetic construct
  REGION 1..964: note = ACE2-740/193/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 103 - protein, 963 aa, synthetic construct
  REGION 1..963: note = ACE2-740/192/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 104 - protein, 962 aa, synthetic construct
  REGION 1..962: note = ACE2-740/191/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGADKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 105 - protein, 961 aa, synthetic construct
  REGION 1..961: note = ACE2-740/190/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 106 - protein, 960 aa, synthetic construct
  REGION 1..960: note = ACE2-740/189/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 107 - protein, 959 aa, synthetic construct
  REGION 1..959: note = ACE2-740/188/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMADKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 108 - protein, 958 aa, synthetic construct
  REGION 1..958: note = ACE2-740/187/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 109 - protein, 957 aa, synthetic construct
  REGION 1..957: note = ACE2-740/186/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 110 - protein, 956 aa, synthetic construct
  REGION 1..956: note = ACE2-740/185/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 111 - protein, 955 aa, synthetic construct
  REGION 1..955: note = ACE2-740/184/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 112 - protein, 954 aa, synthetic construct
  REGION 1..954: note = ACE2-740/183/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 113 - protein, 963 aa, synthetic construct
  REGION 1..963: note = ACE2-740/G14/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSGGGGAGGGGAGGGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 114 - protein, 961 aa, synthetic construct
  REGION 1..961: note = ACE2-740/G12/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSGGAGGGGAGGGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 115 - protein, 959 aa, synthetic construct
  REGION 1..959: note = ACE2-740/G10/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSAGGGGAGGGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 116 - protein, 957 aa, synthetic construct
  REGION 1..957: note = ACE2-740/G8/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSGGGAGGGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 117 - protein, 956 aa, synthetic construct
  REGION 1..956: note = ACE2-740/G7/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSGGAGGGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 118 - protein, 955 aa, synthetic construct
  REGION 1..955: note = ACE2-740/G6/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSGAGGGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 119 - protein, 954 aa, synthetic construct
  REGION 1..954: note = ACE2-740/G5/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSAGGGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 120 - protein, 228 aa, synthetic construct
  REGION 1..228: note = Human IgG1 Fc domain having the N-terminal sequence CDKTHTCPPCPAPE
CDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - DNA, 684 bp, synthetic construct
  misc_feature 1..684: note = DNA encoding human IgG1 Fc domain having the N-terminal sequence CDKTHTCPPCPAPE
  source 1..684: mol_type = other DNA
tgtgacaaaactcacacatgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 122 - protein, 251 aa, synthetic construct
  REGION 1..251: note = pre-Fc chimeric polypeptide having SHH signal peptide
MLLLARCLLLVLVSSLLVCSGLACDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 123 - DNA, 785 bp, synthetic construct
  misc_feature 1..785: note = DNA encoding pre-Fc chimeric polypeptide having SHH signal peptide
  source 1..785: mol_type = other DNA
aagcttgaattcccaccatgctgctgctggcgagatgtctgctgctagtcctcgtctcctcgctgctggtatgctcgggactggcgtgtgacaaaactcacacatgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 124 - protein, 251 aa, synthetic construct
  REGION 1..251: note = pre-Fc chimeric polypeptide having IFN signal peptide
MALTFALLVALLVLSCKSSCSVGCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - DNA, 785 bp, synthetic construct
  misc_feature 1..785: note = DNA encoding pre-Fc chimeric polypeptide having IFN signal peptide
  source 1..785: mol_type = other DNA
aagcttgaattcccaccatggccttgacctttgctttactggtggccctcctggtgctcagctgcaagtcaagctgctctgtgggctgtgacaaaactcacacatgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 126 - protein, 245 aa, synthetic construct
  REGION 1..245: note = pre-Fc chimeric polypeptide having CETP signal peptide
MLAATVLTLALLGNAHACDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - DNA, 767 bp, synthetic construct
  misc_feature 1..767: note = DNA encoding pre-Fc chimeric polypeptide having CETP signal peptide
  source 1..767: mol_type = other DNA
aagcttgaattcccaccatgctggctgccacagtcctgaccctggccctgctgggcaatgcccatgcctgtgacaaaactcacacatgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 128 - protein, 222 aa, synthetic construct; identical to SEQ ID NO: 3
  REGION 1..222: note = Human IgG1 Fc domain having the N-terminal sequence CPPCPAPE

SEQ ID NO: 129 - DNA, 666 bp, synthetic construct
  misc_feature 1..666: note = DNA encoding human IgG1 Fc domain having the N-terminal sequence CPPCPAPE
  source 1..666: mol_type = other DNA
tgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 130 - protein, 245 aa, synthetic construct
  REGION 1..245: note = pre-Fc chimeric polypeptide having SHH signal peptide
MLLLARCLLLVLVSSLLVCSGLACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - DNA, 767 bp, synthetic construct
  misc_feature 1..767: note = DNA encoding pre-Fc chimeric polypeptide having SHH signal peptide
  source 1..767: mol_type = other DNA
aagcttgaattcccaccatgctgctgctggcgagatgtctgctgctagtcctcgtctcctcgctgctggtatgctcgggactggcgtgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 132 - protein, 245 aa, synthetic construct
  REGION 1..245: note = pre-Fc chimeric polypeptide having IFN signal peptide
MALTFALLVALLVLSCKSSCSVGCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 133 - DNA, 767 bp, synthetic construct
  misc_feature 1..767: note = DNA encoding pre-Fc chimeric polypeptide having IFN signal peptide
  source 1..767: mol_type = other DNA
aagcttgaattcccaccatggccttgacctttgctttactggtggccctcctggtgctcagctgcaagtcaagctgctctgtgggctgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 134 - protein, 239 aa, synthetic construct
  REGION 1..239: note = pre-Fc chimeric polypeptide having CETP signal peptide
MLAATVLTLALLGNAHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 135 - DNA, 749 bp, synthetic construct
  misc_feature 1..749: note = DNA encoding pre-Fc chimeric polypeptide having CETP signal peptide
  source 1..749: mol_type = other DNA
aagcttgaattcccaccatgctggctgccacagtcctgaccctggccctgctgggcaatgcccatgcctgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 136 - protein, 219 aa, synthetic construct
  REGION 1..219: note = Human IgG1 Fc domain having the N-terminal sequence CPAPE
CPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 137 - DNA, 657 bp, synthetic construct
  misc_feature 1..657: note = DNA encoding human IgG1 Fc domain having the N-terminal sequence CPAPE
  source 1..657: mol_type = other DNA
tgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 138 - protein, 242 aa, synthetic construct
  REGION 1..242: note = pre-Fc chimeric polypeptide having SHH signal peptide
MLLLARCLLLVLVSSLLVCSGLACPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 139 - DNA, 758 bp, synthetic construct
  misc_feature 1..758: note = DNA encoding pre-Fc chimeric polypeptide having SHH signal peptide
  source 1..758: mol_type = other DNA
aagcttgaattcccaccatgctgctgctggcgagatgtctgctgctagtcctcgtctcctcgctgctggtatgctcgggactggcgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 140 - protein, 242 aa, synthetic construct
  REGION 1..242: note = pre-Fc chimeric polypeptide having IFN signal peptide
MALTFALLVALLVLSCKSSCSVGCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 141 - DNA, 758 bp, synthetic construct
  misc_feature 1..758: note = DNA encoding pre-Fc chimeric polypeptide having IFN signal peptide
  source 1..758: mol_type = other DNA
aagcttgaattcccaccatggccttgacctttgctttactggtggccctcctggtgctcagctgcaagtcaagctgctctgtgggctgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 142 - protein, 236 aa, synthetic construct
  REGION 1..236: note = pre-Fc chimeric polypeptide having CETP signal peptide
MLAATVLTLALLGNAHACPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 143 - DNA, 740 bp, synthetic construct
  misc_feature 1..740: note = DNA encoding pre-Fc chimeric polypeptide having CETP signal peptide
  source 1..740: mol_type = other DNA
aagcttgaattcccaccatgctggctgccacagtcctgaccctggccctgctgggcaatgcccatgcctgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 144 - protein, 225 aa, synthetic construct
  REGION 1..225: note = Human IgG2 Fc domain having the N-terminal sequence CCVECPPCPAPE
CCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 145 - DNA, 675 bp, synthetic construct
  misc_feature 1..675: note = DNA encoding human IgG2 Fc domain having the N-terminal sequence CCVECPPCPAPE
  source 1..675: mol_type = other DNA
tgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 146 - protein, 248 aa, synthetic construct
  REGION 1..248: note = pre-Fc chimeric polypeptide having SHH signal peptide
MLLLARCLLLVLVSSLLVCSGLACCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 147 - DNA, 776 bp, synthetic construct
  misc_feature 1..776: note = DNA encoding pre-Fc chimeric polypeptide having SHH signal peptide
  source 1..776: mol_type = other DNA
aagcttgaattcccaccatgctgctgctggcgagatgtctgctgctagtcctcgtctcctcgctgctggtatgctcgggactggcgtgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 148 - protein, 248 aa, synthetic construct
  REGION 1..248: note = pre-Fc chimeric polypeptide having IFN signal peptide
MALTFALLVALLVLSCKSSCSVGCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 149 - DNA, 776 bp, synthetic construct
  misc_feature 1..776: note = DNA encoding pre-Fc chimeric polypeptide having IFN signal peptide
  source 1..776: mol_type = other DNA
aagcttgaattcccaccatggccttgacctttgctttactggtggccctcctggtgctcagctgcaagtcaagctgctctgtgggctgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 150 - protein, 242 aa, synthetic construct
  REGION 1..242: note = pre-Fc chimeric polypeptide having CETP signal peptide
MLAATVLTLALLGNAHACCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 151 - DNA, 758 bp, synthetic construct
  misc_feature 1..758: note = DNA encoding pre-Fc chimeric polypeptide having CETP signal peptide
  source 1..758: mol_type = other DNA
aagcttgaattcccaccatgctggctgccacagtcctgaccctggccctgctgggcaatgcccatgcctgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 152 - protein, 224 aa, synthetic construct
  REGION 1..224: note = Human IgG2 Fc domain having the N-terminal sequence CVECPPCPAPE
CVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 153 - DNA, 672 bp, synthetic construct
  misc_feature 1..672: note = DNA encoding human IgG2 Fc domain having the N-terminal sequence CVECPPCPAPE
  source 1..672: mol_type = other DNA
tgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 154 - protein, 247 aa, synthetic construct
  REGION 1..247: note = pre-Fc chimeric polypeptide having SHH signal peptide
MLLLARCLLLVLVSSLLVCSGLACVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 155 - DNA, 773 bp, synthetic construct
  misc_feature 1..773: note = DNA encoding pre-Fc chimeric polypeptide having SHH signal peptide
  source 1..773: mol_type = other DNA
aagcttgaattcccaccatgctgctgctggcgagatgtctgctgctagtcctcgtctcctcgctgctggtatgctcgggactggcgtgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 156 - protein, 247 aa, synthetic construct
  REGION 1..247: note = pre-Fc chimeric polypeptide having IFN signal peptide
MALTFALLVALLVLSCKSSCSVGCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 157 - DNA, 773 bp, synthetic construct
  misc_feature 1..773: note = DNA encoding pre-Fc chimeric polypeptide having IFN signal peptide
  source 1..773: mol_type = other DNA
aagcttgaattcccaccatggccttgacctttgctttactggtggccctcctggtgctcagctgcaagtcaagctgctctgtgggctgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 158 - protein, 241 aa, synthetic construct
  REGION 1..241: note = pre-Fc chimeric polypeptide having CETP signal peptide
MLAATVLTLALLGNAHACVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 159 - DNA, 755 bp, synthetic construct
  misc_feature 1..755: note = DNA encoding pre-Fc chimeric polypeptide having CETP signal peptide
  source 1..755: mol_type = other DNA
aagcttgaattcccaccatgctggctgccacagtcctgaccctggccctgctgggcaatgcccatgcctgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 160 - protein, 221 aa, synthetic construct
  REGION 1..221: note = Human IgG2 Fc domain having the N-terminal sequence CPPCPAPE
CPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 161 - DNA, 663 bp, synthetic construct
  misc_feature 1..663: note = DNA encoding human IgG2 Fc domain having the N-terminal sequence CPPCPAPE
  source 1..663: mol_type = other DNA
tgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 162 - protein, 244 aa, synthetic construct
  REGION 1..244: note = pre-Fc chimeric polypeptide having SHH signal peptide
MLLLARCLLLVLVSSLLVCSGLACPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 163 - DNA, 764 bp, synthetic construct
  misc_feature 1..764: note = DNA encoding pre-Fc chimeric polypeptide having SHH signal peptide
  source 1..764: mol_type = other DNA
aagcttgaattcccaccatgctgctgctggcgagatgtctgctgctagtcctcgtctcctcgctgctggtatgctcgggactggcgtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 164 - protein, 244 aa, synthetic construct
  REGION 1..244: note = pre-Fc chimeric polypeptide having IFN signal peptide
MALTFALLVALLVLSCKSSCSVGCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 165 - DNA, 764 bp, synthetic construct
  misc_feature 1..764: note = DNA encoding pre-Fc chimeric polypeptide having IFN signal peptide
  source 1..764: mol_type = other DNA
aagcttgaattcccaccatggccttgacctttgctttactggtggccctcctggtgctcagctgcaagtcaagctgctctgtgggctgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 166 - protein, 238 aa, synthetic construct
  REGION 1..238: note = pre-Fc chimeric polypeptide having CETP signal peptide
MLAATVLTLALLGNAHACPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 167 - DNA, 746 bp, synthetic construct
  misc_feature 1..746: note = DNA encoding pre-Fc chimeric polypeptide having CETP signal peptide
  source 1..746: mol_type = other DNA
aagcttgaattcccaccatgctggctgccacagtcctgaccctggccctgctgggcaatgcccatgcctgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 168 - protein, 218 aa, synthetic construct
  REGION 1..218: note = Human IgG2 Fc domain having the N-terminal sequence CPAPE
CPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 169 - DNA, 654 bp, synthetic construct
  misc_feature 1..654: note = DNA encoding human IgG2 Fc domain having the N-terminal sequence CPAPE
  source 1..654: mol_type = other DNA
tgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 170 - protein, 241 aa, synthetic construct
  REGION 1..241: note = pre-Fc chimeric polypeptide having SHH signal peptide
MLLLARCLLLVLVSSLLVCSGLACPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 171 - DNA, 755 bp, synthetic construct
  misc_feature 1..755: note = DNA encoding pre-Fc chimeric polypeptide having SHH signal peptide
  source 1..755: mol_type = other DNA
aagcttgaattcccaccatgctgctgctggcgagatgtctgctgctagtcctcgtctcctcgctgctggtatgctcgggactggcgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 172 - protein, 241 aa, synthetic construct
  REGION 1..241: note = pre-Fc chimeric polypeptide having IFN signal peptide
MALTFALLVALLVLSCKSSCSVGCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 173 - DNA, 755 bp, synthetic construct
  misc_feature 1..755: note = DNA encoding pre-Fc chimeric polypeptide having IFN signal peptide
  source 1..755: mol_type = other DNA
aagcttgaattcccaccatggccttgacctttgctttactggtggccctcctggtgctcagctgcaagtcaagctgctctgtgggctgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 174 - protein, 235 aa, synthetic construct
  REGION 1..235: note = pre-Fc chimeric polypeptide having CETP signal peptide
MLAATVLTLALLGNAHACPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 175 - DNA, 737 bp, synthetic construct
  misc_feature 1..737: note = DNA encoding pre-Fc chimeric polypeptide having CETP signal peptide
  source 1..737: mol_type = other DNA
aagcttgaattcccaccatgctggctgccacagtcctgaccctggccctgctgggcaatgcccatgcctgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggccg

SEQ ID NO: 176 - protein, 267 aa, synthetic construct
  REGION 1..267: note = Human IgG3 Fc domain having the N-terminal sequence (CPRCPEPKSDTPPP)3-CPRCPAPE
CPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 177 - DNA, 801 bp, synthetic construct
  misc_feature 1..801: note = DNA encoding human IgG3 Fc domain having the N-terminal sequence (CPRCPEPKSDTPPP)3-CPRCPAPE
  source 1..801: mol_type = other DNA
tgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaa

SEQ ID NO: 178 - protein, 290 aa, synthetic construct
  REGION 1..290: note = pre-Fc chimeric polypeptide having SHH signal peptide
MLLLARCLLLVLVSSLLVCSGLACPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 179 - DNA, 902 bp, synthetic construct
  misc_feature 1..902: note = DNA encoding pre-Fc chimeric polypeptide having SHH signal peptide
  source 1..902: mol_type = other DNA
aagcttgaattcccaccatgctgctgctggcgagatgtctgctgctagtcctcgtctcctcgctgctggtatgctcgggactggcgtgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 180 - protein, 290 aa, synthetic construct
  REGION 1..290: note = pre-Fc chimeric polypeptide having IFN signal peptide
MALTFALLVALLVLSCKSSCSVGCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 181 - DNA, 902 bp, synthetic construct
  misc_feature 1..902: note = DNA encoding pre-Fc chimeric polypeptide having IFN signal peptide
  source 1..902: mol_type = other DNA
aagcttgaattcccaccatggccttgacctttgctttactggtggccctcctggtgctcagctgcaagtcaagctgctctgtgggctgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 182 - protein, 284 aa, synthetic construct
  REGION 1..284: note = pre-Fc chimeric polypeptide having CETP signal peptide
MLAATVLTLALLGNAHACPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 183 - DNA, 884 bp, synthetic construct
  misc_feature 1..884: note = DNA encoding pre-Fc chimeric polypeptide having CETP signal peptide
  source 1..884: mol_type = other DNA
aagcttgaattcccaccatgctggctgccacagtcctgaccctggccctgctgggcaatgcccatgcctgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 184 - protein, 222 aa, synthetic construct
  REGION 1..222: note = Human IgG3 Fc domain having the N-terminal sequence CPRCPAPE
CPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 185 - DNA, 681 bp, synthetic construct
  misc_feature 1..681: note = DNA encoding human IgG3 Fc domain having the N-terminal sequence CPRCPAPE
  source 1..681: mol_type = other DNA
tgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 186 - protein, 245 aa, synthetic construct
  REGION 1..245: note = pre-Fc chimeric polypeptide having SHH signal peptide
MLLLARCLLLVLVSSLLVCSGLACPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 187 - DNA, 767 bp, synthetic construct
  misc_feature 1..767: note = DNA encoding pre-Fc chimeric polypeptide having SHH signal peptide
  source 1..767: mol_type = other DNA
aagcttgaattcccaccatgctgctgctggcgagatgtctgctgctagtcctcgtctcctcgctgctggtatgctcgggactggcgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 188 - protein, 245 aa, synthetic construct
  REGION 1..245: note = pre-Fc chimeric polypeptide having IFN signal peptide
MALTFALLVALLVLSCKSSCSVGCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 189 - DNA, 767 bp, synthetic construct
  misc_feature 1..767: note = DNA encoding pre-Fc chimeric polypeptide having IFN signal peptide
  source 1..767: mol_type = other DNA
aagcttgaattcccaccatggccttgacctttgctttactggtggccctcctggtgctcagctgcaagtcaagctgctctgtgggctgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 190 - protein, 239 aa, synthetic construct
  REGION 1..239: note = pre-Fc chimeric polypeptide having CETP signal peptide
MLAATVLTLALLGNAHACPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 191 - DNA, 749 bp, synthetic construct
  misc_feature 1..749: note = DNA encoding pre-Fc chimeric polypeptide having CETP signal peptide
  source 1..749: mol_type = other DNA
aagcttgaattcccaccatgctggctgccacagtcctgaccctggccctgctgggcaatgcccatgcctgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 192 - protein, 219 aa, synthetic construct
  REGION 1..219: note = Human IgG3 Fc domain having the N-terminal sequence CPAPE
CPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 193 - DNA, 672 bp, synthetic construct
  misc_feature 1..672: note = DNA encoding human IgG3 Fc domain having the N-terminal sequence CPAPE
  source 1..672: mol_type = other DNA
tgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 194 - protein, 242 aa, synthetic construct
  REGION 1..242: note = pre-Fc chimeric polypeptide having SHH signal peptide
MLLLARCLLLVLVSSLLVCSGLACPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 195 - DNA, 758 bp, synthetic construct
  misc_feature 1..758: note = DNA encoding pre-Fc chimeric polypeptide having SHH signal peptide
  source 1..758: mol_type = other DNA
aagcttgaattcccaccatgctgctgctggcgagatgtctgctgctagtcctcgtctcctcgctgctggtatgctcgggactggcgtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 196 - protein, 242 aa, synthetic construct
  REGION 1..242: note = pre-Fc chimeric polypeptide having IFN signal peptide
MALTFALLVALLVLSCKSSCSVGCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 197 - DNA, 758 bp, synthetic construct
  misc_feature 1..758: note = DNA encoding pre-Fc chimeric polypeptide having IFN signal peptide
  source 1..758: mol_type = other DNA
aagcttgaattcccaccatggccttgacctttgctttactggtggccctcctggtgctcagctgcaagtcaagctgctctgtgggctgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 198 - protein, 235 aa, synthetic construct
  REGION 1..235: note = pre-Fc chimeric polypeptide having CETP signal peptide
MLAATVLTLALLGNAHACPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPG

SEQ ID NO: 199 - DNA, 740 bp, synthetic construct
  misc_feature 1..740: note = DNA encoding pre-Fc chimeric polypeptide having CETP signal peptide
  source 1..740: mol_type = other DNA
aagcttgaattcccaccatgctggctgccacagtcctgaccctggccctgctgggcaatgcccatgcctgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgactcgagcggccg

SEQ ID NO: 200 - protein, 222 aa, synthetic construct
  REGION 1..222: note = Human IgG4 Fc domain having the N-terminal sequence CPSCPAPE
CPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 201 - DNA, 666 bp, synthetic construct
  misc_feature 1..666: note = DNA encoding human IgG4 Fc domain having the N-terminal sequence CPSCPAPE
  source 1..666: mol_type = other DNA
tgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 202 - protein, 245 aa, synthetic construct
  REGION 1..245: note = pre-Fc chimeric polypeptide having a SHH signal peptide
MLLLARCLLLVLVSSLLVCSGLACPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 203 - DNA, 767 bp, synthetic construct
  misc_feature 1..767: note = DNA encoding pre-Fc chimeric polypeptide having a SHH signal peptide
  source 1..767: mol_type = other DNA
aagcttgaattcccaccatgctgctgctggcgagatgtctgctgctagtcctcgtctcctcgctgctggtatgctcgggactggcgtgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgactcgagcggccg

SEQ ID NO: 204 - protein, 245 aa, synthetic construct
  REGION 1..245: note = pre-Fc chimeric polypeptide having a IFN signal peptide
MALTFALLVALLVLSCKSSCSVGCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205 - DNA, 767 bp, synthetic construct
  misc_feature 1..767: note = DNA encoding pre-Fc chimeric polypeptide having a IFN signal peptide
  source 1..767: mol_type = other DNA
aagcttgaattcccaccatggccttgacctttgctttactggtggccctcctggtgctcagctgcaagtcaagctgctctgtgggctgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgactcgagcggccg

SEQ ID NO: 206 - protein, 239 aa, synthetic construct
  REGION 1..239: note = pre-Fc chimeric polypeptide having a CETP signal peptide
MLAATVLTLALLGNAHACPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 207 - DNA, 749 bp, synthetic construct
  misc_feature 1..749: note = DNA encoding pre-Fc chimeric polypeptide having a CETP signal peptide
  source 1..749: mol_type = other DNA
aagcttgaattcccaccatgctggctgccacagtcctgaccctggccctgctgggcaatgcccatgcctgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgactcgagcggccg

SEQ ID NO: 208 - protein, 219 aa, synthetic construct
  REGION 1..219: note = Human IgG4 Fc domain having the N-terminal sequence CPAPE
CPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 209 - DNA, 657 bp, synthetic construct
  misc_feature 1..657: note = DNA encoding human IgG4 Fc domain having the N-terminal sequence CPAPE
  source 1..657: mol_type = other DNA
tgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 210 - protein, 242 aa, synthetic construct
  REGION 1..242: note = pre-Fc chimeric polypeptide having a SHH signal peptide
MLLLARCLLLVLVSSLLVCSGLACPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 211 - DNA, 758 bp, synthetic construct
  misc_feature 1..758: note = DNA encoding pre-Fc chimeric polypeptide having a SHH signal peptide
  source 1..758: mol_type = other DNA
aagcttgaattcccaccatgctgctgctggcgagatgtctgctgctagtcctcgtctcctcgctgctggtatgctcgggactggcgtgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgactcgagcggccg

SEQ ID NO: 212 - protein, 242 aa, synthetic construct
  REGION 1..242: note = pre-Fc chimeric polypeptide having a IFN signal peptide
MALTFALLVALLVLSCKSSCSVGCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 213 - DNA, 758 bp, synthetic construct
  misc_feature 1..758: note = DNA encoding pre-Fc chimeric polypeptide having a IFN signal peptide
  source 1..758: mol_type = other DNA
aagcttgaattcccaccatggccttgacctttgctttactggtggccctcctggtgctcagctgcaagtcaagctgctctgtgggctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgactcgagcggccg

SEQ ID NO: 214 - protein, 236 aa, synthetic construct
  REGION 1..236: note = pre-Fc chimeric polypeptide having a CETP signal peptide
MLAATVLTLALLGNAHACPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 215 - DNA, 740 bp, synthetic construct
  misc_feature 1..740: note = DNA encoding pre-Fc chimeric polypeptide having a CETP signal peptide
  source 1..740: mol_type = other DNA
aagcttgaattcccaccatgctggctgccacagtcctgaccctggccctgctgggcaatgcccatgcctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgactcgagcggccg

SEQ ID NO: 216 - DNA, 5428 bp, synthetic construct
  misc_feature 1..5428: note = pCDNA3.1(+)
  source 1..5428: mol_type = other DNA
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttggtaccgagctcggatccactagtccagtgtggtggaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 217 - DNA, 4195 bp, synthetic construct
  misc_feature 1..4195: note = pSA
  source 1..4195: mol_type = other DNA
ctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcaagcggccgcaacccgggaaaagcttggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcatgctcccctgctccgacccgggctcctcgcccgcccggacccacaggccaccctcaaccgtcctggccccggacccaaaccccacccctcactctgcttctccccgcaggagaattcaatcgcgaaagggcccaaagatctgccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggagctagcatcccgcccctaactccgccctgttccgcccattctccgccccatggctgactaattttttttatttatgcagaggccgaggccgcctcggcctctgagctattccagaagtagtgaggaggcttttttggaggcctaggcttttgcgtcgagaagcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 218 - DNA, 824 bp, synthetic construct
  misc_feature 1..824: note = Artificial Construct
  source 1..824: mol_type = other DNA
gttaacgaattcccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaagatctgttaac

SEQ ID NO: 219 - DNA, 6739 bp, synthetic construct
  misc_feature 1..6739: note = pCDNA3-TNR1B-Mth
  source 1..6739: mol_type = other DNA
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgaattcccaccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatggggcccagccccccagctgaagggagcactggcgacgggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgactcgagcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 220 - protein, 457 aa, synthetic construct
  REGION 1..457: note = pre-TNR1B-intein chimeric polypeptide
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 221 - protein, 435 aa, synthetic construct
  REGION 1..435: note = mature TNR1B-intein fusion protein
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 222 - DNA, 6103 bp, synthetic construct
  misc_feature 1..6103: note = pCDNA3-SHH-IgG1-Fc11
  source 1..6103: mol_type = other DNA
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgaattcccaccatgctgctgctggcgagatgtctgctgctagtcctcgtctcctcgctgctggtatgctcgggactggcgtgcccaccgtgcccagcacctgaactcctgggggggccctcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgactcgagcggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 223 - protein, 245 aa, synthetic construct; identical to SEQ ID NO: 130
  REGION 1..245: note = pre-Fc6 polypeptide

SEQ ID NO: 224 - protein, 222 aa, synthetic construct; identical to SEQ ID NO: 3
  REGION 1..222: note = mature Fc6 protein

SEQ ID NO: 225 - protein, 237 aa, synthetic construct
  REGION 1..237: note = cleaved alkyne-modified TNR1B
  SITE 237: note = Xaa = cysteine-alkyne
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDGX

SEQ ID NO: 226 - protein, 237 aa, synthetic construct; identical to SEQ ID NO: 225
  REGION 1..237: note = azide-modified TNR1B protein
  SITE 237: note = Xaa = cysteine-azide

SEQ ID NO: 227 - protein, 237 aa, synthetic construct
  REGION 1..237: note = cysteine-modified TNR1B
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDGC

SEQ ID NO: 228 - protein, 236 aa, synthetic construct
  REGION 1..236: note = thioester-modified TNR1B
  SITE 236: note = Xaa = glycine-thioester
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDX

SEQ ID NO: 229 - protein, 227 aa, synthetic construct
  REGION 1..227: note = Az-DKTHT-Fc6 protein
  SITE 1: note = Xaa = azide-aspartic acid
XKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 230 - protein, 227 aa, synthetic construct; identical to SEQ ID NO: 229
  REGION 1..227: note = Az-PEG4-DKTHT-Fc6
  SITE 1: note = Xaa = azide-PEG4-aspartic acid

SEQ ID NO: 231 - protein, 465 aa, synthetic construct
  REGION 1..465: note = Polypeptide with internal non-peptidyl moiety. TNR1B-alkyne-azide-Fc6
  SITE 238: note = Xaa = non-peptidyl moiety
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDGCXDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 232 - protein, 465 aa, synthetic construct; identical to SEQ ID NO: 231
  REGION 1..465: note = Polypeptide with internal non-peptidyl moiety. TNR1B-alkyne-azide-PEG4-Fc6
  SITE 238: note = Xaa = non-peptidyl moiety containing PEG4 linker

SEQ ID NO: 233 - protein, 467 aa, synthetic construct
  REGION 1..467: note = Etanercept
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 234 - DNA, 4175 bp, synthetic construct
  misc_feature 1..4175: note = pFUSE2ss-DE27-V -CLIg-hk
  source 1..4175: mol_type = other DNA
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaacatgtacaggatgcaactcctgtcttgcattgcactaagtcttgcacttgtcacgaattcagacatccagatgacccagtctccatcctccctgtctgcatctgtaggggacagagtcaccatcacttgtcgggcaagtcagggcatcagaaattacttagcctggtatcagcaaaaaccagggaaagcccctaagctcctgatctatgctgcatccactttgcaatcaggggtcccatctcggttcagtggcagtggatctgggacagatttcactctcaccatcagcagcctacagcctgaagatgttgcaacttattactgtcaaaggtataaccgtgcaccgtatacttttggccaggggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagctagctcgacatgataagatacattgatgagtttggacaaaccacaactagaatgcagtgaaaaaaatgctttatttgtgaaatttgtgatgctattgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagctttagttcctggtgtacttgagggggatgagttcctcaatggtggttttgaccagcttgccattcatctcaatgagcacaaagcagtcaggagcatagtcagagatgagctctctgcacatgccacaggggctgaccaccctgatggatctgtccacctcatcagagtaggggtgcctgacagccacaatggtgtcaaagtccttctgcccgttgctcacagcagacccaatggcaatggcttcagcacagacagtgaccctgccaatgtaggcctcaatgtggacagcagagatgatctccccagtcttggtcctgatggccgccccgacatggtgcttgttgtcctcatagagcatggtgatcttctcagtggcgacctccaccagctccagatcctgctgagagatgttgaaggtcttcatgatggctcctcctgtcaggagaggaaagagaagaaggttagtacaattgctatagtgagttgtattatactatgcttatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 235 - DNA, 4776 bp, synthetic construct
  misc_feature 1..4776: note = pPUSEss-DE27-V 1-CHIg-hG1-Mth-1
  source 1..4776: mol_type = other DNA
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcggaggtgcagctggtggagtctgggggaggcttggtacagcccggcaggtccctgagactctcctgtgcggcctctggattcacctttgatgattatgccatgcactgggtccggcaagctccagggaagggcctggaatgggtctcagctatcacttggaatagtggtcacatagactatgcggactctgtggagggccgattcaccatctccagagacaacgccaagaactccctgtatctgcaaatgaacagtctgagagctgaggatacggccgtatattactgtgcgaaagtctcgtaccttagcaccgcgtcctcccttgactattggggccaaggtaccctggtcaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgagtcctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 236 - DNA, 4779 bp, synthetic construct
  misc_feature 1..4779: note = pFUSEss-DE27-V 1-CHIg-hG1-Mth-2
  source 1..4779: mol_type = other DNA
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcggaggtgcagctggtggagtctgggggaggcttggtacagcccggcaggtccctgagactctcctgtgcggcctctggattcacctttgatgattatgccatgcactgggtccggcaagctccagggaagggcctggaatgggtctcagctatcacttggaatagtggtcacatagactatgcggactctgtggagggccgattcaccatctccagagacaacgccaagaactccctgtatctgcaaatgaacagtctgagagctgaggatacggccgtatattactgtgcgaaagtctcgtaccttagcaccgcgtcctcccttgactattggggccaaggtaccctggtcaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacagggtgcgtatccggtgacaccattgtaatgactagtggcgggccccgcactgtggctgaactggagggcaaaccgttcaccgcactgattcgcggctctggctacccatgcccctcaggtttcttccgcacctgtgaacgtgacgtatatgatctgcgtacacgtgagggtcattgcttacgtttgacccatgatcaccgtgttctggtgatggatggtggcctggaatggcgtgccgcgggtgaactggaacgcggcgaccgcctggtgatggatgatgcagctggcgagtttccggcactggcaaccttccgtggcctgcgtggcgctggccgccaggatgtttatgacgctactgtttacggtgctagcgcattcactgctaatggcttcattgtacacgcatgtggcgagcagcccgggaccggtctgaactcaggcctcacgacaaatcctggtgtatccgcttggcaggtcaacacagcttatactgcgggacaattggtcacatataacggcaagacgtataaatgtttgcagccccacacctccttggcaggatgggaaccatccaacgttcctgccttgtggcagcttcaatgagtcctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 237 - protein, 234 aa, synthetic construct
  REGION 1..234: note = pre-kappa light chain of adalimumab
MYRMQLLSCIALSLALVTNSDIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 238 - protein, 214 aa, synthetic construct
  REGION 1..214: note = mature kappa light chain of adalimumab
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 239 - protein, 448 aa, synthetic construct
  REGION 1..448: note = pre-heavy chain-intein chimeric polypeptide
MYRMQLLSCIALSLALVTNSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 240 - protein, 428 aa, synthetic construct
  REGION 1..428: note = mature heavy chain-intein fusion protein
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 241 - protein, 449 aa, synthetic construct
  REGION 1..449: note = pre-heavy chain-intein chimeric polypeptide
MYRMQLLSCIALSLALVTNSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 242 - protein, 429 aa, synthetic construct
  REGION 1..429: note = mature heavy chain-intein fusion protein
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHACGEQPGTGLNSGLTTNPGVSAWQVNTAYTAGQLVTYNGKTYKCLQPHTSLAGWEPSNVPALWQLQ

SEQ ID NO: 243 - protein, 230 aa, synthetic construct
  REGION 1..230: note = Part of alkyne-modified adalimumab Fab-1 protein. Modified at C-Terminus.
  SITE 230: note = Xaa = cysteine-alkyne
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTX

SEQ ID NO: 244 - protein, 231 aa, synthetic construct
  REGION 1..231: note = Part of alkyne-modified adalimumab Fab-2 protein. Motified at C-Terminus
  SITE 131: note = Xaa = cysteine-alkyne
  SITE 231: note = misc_feature - Xaa can be any naturally occurring amino acid
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGX

SEQ ID NO: 245 - protein, 230 aa, synthetic construct; identical to SEQ ID NO: 243
  REGION 1..230: note = Part of azide-modified adalimumab Fab-1 protein. Modified C-Terminus
  SITE 230: note = Xaa = cysteine-azide

SEQ ID NO: 246 - protein, 231 aa, synthetic construct; identical to SEQ ID NO: 244
  REGION 1..231: note = Part of azide-modified adalimumab Fab-2 protein. Modified C-Terminus
  SITE 231: note = Xaa = cysteine-azide

SEQ ID NO: 247 - protein, 214 aa, Homo sapiens
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 248 - protein, 450 aa, Homo sapiens
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 249 - protein, 215 aa, synthetic construct
  REGION 1..215: note = Trastuzumab light chain having the N-terminal sequence C
CDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 250 - protein, 238 aa, synthetic construct
  REGION 1..238: note = pre-light chimeric polypeptide having SHH signal peptide
MLLLARCLLLVLVSSLLVCSGLACDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 251 - protein, 238 aa, synthetic construct
  REGION 1..238: note = pre-light chimeric polypeptide having IFN signal peptide
MALTFALLVALLVLSCKSSCSVGCDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 252 - protein, 232 aa, synthetic construct
  REGION 1..232: note = pre-light chimeric polypeptide having CETP signal peptide
MLAATVLTLALLGNAHACDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 253 - protein, 216 aa, synthetic construct
  REGION 1..216: note = Trastuzumab light chain having the N-terminal sequence CP
CPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 254 - protein, 239 aa, synthetic construct
  REGION 1..239: note = pre-light chimeric polypeptide having SHH signal peptide
MLLLARCLLLVLVSSLLVCSGLACPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 255 - protein, 239 aa, synthetic construct
  REGION 1..239: note = pre-light chimeric polypeptide having IFN signal peptide
MALTFALLVALLVLSCKSSCSVGCPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 256 - protein, 233 aa, synthetic construct
  REGION 1..233: note = pre-light chimeric polypeptide having CETP signal peptide
MLAATVLTLALLGNAHACPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 257 - protein, 217 aa, synthetic construct
  REGION 1..217: note = Trastuzumab light chain having the N-terminal sequence CPP
CPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 258 - protein, 240 aa, synthetic construct
  REGION 1..240: note = pre-light chimeric polypeptide having SHH signal peptide
MLLLARCLLLVLVSSLLVCSGLACPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 259 - protein, 240 aa, synthetic construct
  REGION 1..240: note = pre-light chimeric polypeptide having IFN signal peptide
MALTFALLVALLVLSCKSSCSVGCPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 260 - protein, 234 aa, synthetic construct
  REGION 1..234: note = pre-light chimeric polypeptide having CETP signal peptide
MLAATVLTLALLGNAHACPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 261 - protein, 217 aa, synthetic construct
  REGION 1..217: note = Trastuzumab light chain having the N-terminal sequence CPR
CPRDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 262 - protein, 240 aa, synthetic construct
  REGION 1..240: note = pre-light chimeric polypeptide having SHH signal peptide
MLLLARCLLLVLVSSLLVCSGLACPRDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 263 - protein, 240 aa, synthetic construct
  REGION 1..240: note = pre-light chimeric polypeptide having IFN signal peptide
MALTFALLVALLVLSCKSSCSVGCPRDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 264 - protein, 234 aa, synthetic construct
  REGION 1..234: note = pre-light chimeric polypeptide having CETP signal peptide
MLAATVLTLALLGNAHACPRDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 265 - protein, 217 aa, synthetic construct
  REGION 1..217: note = Trastuzumab light chain having the N-terminal sequence CPS
CPSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 266 - protein, 240 aa, synthetic construct
  REGION 1..240: note = pre-light chimeric polypeptide having SHH signal peptide
MLLLARCLLLVLVSSLLVCSGLACPSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 267 - protein, 240 aa, synthetic construct
  REGION 1..240: note = pre-light chimeric polypeptide having IFN signal peptide
MALTFALLVALLVLSCKSSCSVGCPSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 268 - protein, 234 aa, synthetic construct
  REGION 1..234: note = pre-light chimeric polypeptide having CETP signal peptide
MLAATVLTLALLGNAHACPSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 269 - protein, 218 aa, synthetic construct
  REGION 1..218: note = Trastuzumab light chain having the N-terminal sequence CDKT
CDKTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 270 - protein, 241 aa, synthetic construct
  REGION 1..241: note = pre-light chimeric polypeptide having SHH signal peptide
MLLLARCLLLVLVSSLLVCSGLACDKTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 271 - protein, 241 aa, synthetic construct
  REGION 1..241: note = pre-light chimeric polypeptide having IFN signal peptide
MALTFALLVALLVLSCKSSCSVGCDKTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 272 - protein, 235 aa, synthetic construct
  REGION 1..235: note = pre-light chimeric polypeptide having CETP signal peptide
MLAATVLTLALLGNAHACDKTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 273 - protein, 220 aa, synthetic construct
  REGION 1..220: note = Trastuzumab light chain having the N-terminal sequence CDKTHT
CDKTHTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 274 - protein, 243 aa, synthetic construct
  REGION 1..243: note = pre-light chimeric polypeptide having SHH signal peptide
MLLLARCLLLVLVSSLLVCSGLACDKTHTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 275 - protein, 243 aa, synthetic construct
  REGION 1..243: note = pre-light chimeric polypeptide having IFN signal peptide
MALTFALLVALLVLSCKSSCSVGCDKTHTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 276 - protein, 237 aa, synthetic construct
  REGION 1..237: note = pre-light chimeric polypeptide having CETP signal peptide
MLAATVLTLALLGNAHACDKTHTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 277 - protein, 217 aa, synthetic construct
  REGION 1..217: note = Trastuzumab light chain having the N-terminal sequence CVE
CVEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 278 - protein, 240 aa, synthetic construct
  REGION 1..240: note = pre-light chimeric polypeptide having SHH signal peptide
MLLLARCLLLVLVSSLLVCSGLACVEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 279 - protein, 240 aa, synthetic construct
  REGION 1..240: note = pre-light chimeric polypeptide having IFN signal peptide
MALTFALLVALLVLSCKSSCSVGCVEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 280 - protein, 234 aa, synthetic construct
  REGION 1..234: note = pre-light chimeric polypeptide having CETP signal peptide
MLAATVLTLALLGNAHACVEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 281 - protein, 220 aa, synthetic construct
  REGION 1..220: note = Trastuzumab light chain having the N-terminal sequence CDTPPP
CDTPPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 282 - protein, 243 aa, synthetic construct
  REGION 1..243: note = pre-light chimeric polypeptide having SHH signal peptide
MLLLARCLLLVLVSSLLVCSGLACDTPPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 283 - protein, 243 aa, synthetic construct
  REGION 1..243: note = pre-light chimeric polypeptide having IFN signal peptide
MALTFALLVALLVLSCKSSCSVGCDTPPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 284 - protein, 237 aa, synthetic construct
  REGION 1..237: note = pre-light chimeric polypeptide having CETP signal peptide
MLAATVLTLALLGNAHACDTPPPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 285 - protein, 451 aa, synthetic construct
  REGION 1..451: note = Trastuzumab heavy chain having the N-terminal sequence C
CEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 286 - protein, 474 aa, synthetic construct
  REGION 1..474: note = pre-heavy chain chimeric polypeptide having SHH signal peptide
MLLLARCLLLVLVSSLLVCSGLACEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - protein, 474 aa, synthetic construct
  REGION 1..474: note = pre-heavy chain chimeric polypeptide having IFN signal peptide
MALTFALLVALLVLSCKSSCSVGCEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 288 - protein, 468 aa, synthetic construct
  REGION 1..468: note = pre-heavy chain chimeric polypeptide having CETP signal peptide
MLAATVLTLALLGNAHACEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 289 - protein, 452 aa, synthetic construct
  REGION 1..452: note = Trastuzumab heavy chain having the N-terminal sequence CP
CPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - protein, 475 aa, synthetic construct
  REGION 1..475: note = pre-heavy chain chimeric polypeptide having SHH signal peptide
MLLLARCLLLVLVSSLLVCSGLACPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 475 aa, synthetic construct
  REGION 1..475: note = pre-heavy chain chimeric polypeptide having IFN signal peptide
MALTFALLVALLVLSCKSSCSVGCPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - protein, 469 aa, synthetic construct
  REGION 1..469: note = pre-heavy chain chimeric polypeptide having CETP signal peptide
MLAATVLTLALLGNAHACPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - protein, 453 aa, synthetic construct
  REGION 1..453: note = Trastuzumab heavy chain having the N-terminal sequence CPP
CPPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - protein, 476 aa, synthetic construct
  REGION 1..476: note = pre-heavy chain chimeric polypeptide having SHH signal peptide
MLLLARCLLLVLVSSLLVCSGLACPPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 295 - protein, 476 aa, synthetic construct
  REGION 1..476: note = pre-heavy chain chimeric polypeptide having IFN signal peptide
MALTFALLVALLVLSCKSSCSVGCPPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 296 - protein, 470 aa, synthetic construct
  REGION 1..470: note = pre-heavy chain chimeric polypeptide having CETP signal peptide
MLAATVLTLALLGNAHACPPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - protein, 453 aa, synthetic construct
  REGION 1..453: note = Trastuzumab heavy chain having the N-terminal sequence CPR
CPREVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 298 - protein, 476 aa, synthetic construct
  REGION 1..476: note = pre-heavy chain chimeric polypeptide having SHH signal peptide
MLLLARCLLLVLVSSLLVCSGLACPREVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - protein, 476 aa, synthetic construct
  REGION 1..476: note = pre-heavy chain chimeric polypeptide having IFN signal peptide
MALTFALLVALLVLSCKSSCSVGCPREVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 470 aa, synthetic construct
  REGION 1..470: note = pre-heavy chain chimeric polypeptide having CETP signal peptide
MLAATVLTLALLGNAHACPREVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - protein, 453 aa, synthetic construct
  REGION 1..453: note = Trastuzumab heavy chain having the N-terminal sequence CPS
CPSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 302 - protein, 476 aa, synthetic construct
  REGION 1..476: note = pre-heavy chain chimeric polypeptide having SHH signal peptide
MLLLARCLLLVLVSSLLVCSGLACPSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 303 - protein, 476 aa, synthetic construct
  REGION 1..476: note = pre-heavy chain chimeric polypeptide having IFN signal peptide
MALTFALLVALLVLSCKSSCSVGCPSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 304 - protein, 470 aa, synthetic construct
  REGION 1..470: note = pre-heavy chain chimeric polypeptide having CETP signal peptide
MLAATVLTLALLGNAHACPSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - protein, 454 aa, synthetic construct
  REGION 1..454: note = Trastuzumab heavy chain having the N-terminal sequence CDKT
CDKTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - protein, 477 aa, synthetic construct
  REGION 1..477: note = pre-heavy chain chimeric polypeptide having SHH signal peptide
MLLLARCLLLVLVSSLLVCSGLACDKTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 307 - protein, 477 aa, synthetic construct
  REGION 1..477: note = pre-heavy chain chimeric polypeptide having IFN signal peptide
MALTFALLVALLVLSCKSSCSVGCDKTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 308 - protein, 471 aa, synthetic construct
  REGION 1..471: note = pre-heavy chain chimeric polypeptide having CETP signal peptide
MLAATVLTLALLGNAHACDKTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 309 - protein, 456 aa, synthetic construct
  REGION 1..456: note = Trastuzumab heavy chain having the N-terminal sequence CDKTHT
CDKTHTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 310 - protein, 479 aa, synthetic construct
  REGION 1..479: note = pre-heavy chain chimeric polypeptide having SHH signal peptide
MLLLARCLLLVLVSSLLVCSGLACDKTHTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 311 - protein, 479 aa, synthetic construct
  REGION 1..479: note = pre-heavy chain chimeric polypeptide having IFN signal peptide
MALTFALLVALLVLSCKSSCSVGCDKTHTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 312 - protein, 473 aa, synthetic construct
  REGION 1..473: note = pre-heavy chain chimeric polypeptide having CETP signal peptide
MLAATVLTLALLGNAHACDKTHTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 313 - protein, 453 aa, synthetic construct
  REGION 1..453: note = Trastuzumab heavy chain having the N-terminal sequence CVE
CVEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 314 - protein, 476 aa, synthetic construct
  REGION 1..476: note = pre-heavy chain chimeric polypeptide having SHH signal peptide
MLLLARCLLLVLVSSLLVCSGLACVEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 315 - protein, 476 aa, synthetic construct
  REGION 1..476: note = pre-heavy chain chimeric polypeptide having IFN signal peptide
MALTFALLVALLVLSCKSSCSVGCVEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 316 - protein, 470 aa, synthetic construct
  REGION 1..470: note = pre-heavy chain chimeric polypeptide having CETP signal peptide
MLAATVLTLALLGNAHACVEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 317 - protein, 456 aa, synthetic construct
  REGION 1..456: note = Trastuzumab heavy chain having the N-terminal sequence CDTPPP
CDTPPPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 318 - protein, 479 aa, synthetic construct
  REGION 1..479: note = pre-heavy chain chimeric polypeptide having SHH signal peptide
MLLLARCLLLVLVSSLLVCSGLACDTPPPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 319 - protein, 479 aa, synthetic construct
  REGION 1..479: note = pre-heavy chain chimeric polypeptide having IFN signal peptide
MALTFALLVALLVLSCKSSCSVGCDTPPPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 320 - protein, 473 aa, synthetic construct
  REGION 1..473: note = pre-heavy chain chimeric polypeptide having CETP signal peptide
MLAATVLTLALLGNAHACDTPPPEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 321 - protein, 31 aa, Homo sapiens
HGEGTFTSDVSSYLEEQAAKEFIAWLVKGRG

SEQ ID NO: 322 - DNA, 22 bp, Homo sapiens
  source 1..22: mol_type = genomic DNA
agaggtagtaggttgcatagtt

SEQ ID NO: 323 - protein, 237 aa, synthetic construct; identical to SEQ ID NO: 227
  REGION 1..237: note = TNR1B

SEQ ID NO: 324 - protein, 222 aa, synthetic construct; identical to SEQ ID NO: 3
  REGION 1..222: note = Fc6

SEQ ID NO: 325 - protein, 5 aa, synthetic construct
  REGION 1..5: note = N-Terminus Sequence
CPPCP

SEQ ID NO: 326 - protein, 5 aa, synthetic construct
  REGION 1..5: note = N-Terminal Sequence
CPRCP

SEQ ID NO: 327 - protein, 5 aa, synthetic construct
  REGION 1..5: note = N-Terminal Sequence
CPSCP

SEQ ID NO: 328 - protein, 11 aa, synthetic construct
  REGION 1..11: note = N-Terminal Sequence
CDKTHTCPPCP

SEQ ID NO: 329 - protein, 8 aa, synthetic construct
  REGION 1..8: note = N-Terminal Sequence
CVECPPCP

SEQ ID NO: 330 - protein, 9 aa, synthetic construct
  REGION 1..9: note = N-Terminal Sequence
CCVECPPCP

SEQ ID NO: 331 - protein, 11 aa, synthetic construct
  REGION 1..11: note = N-Terminal Sequence
CDTPPPCPRCP

SEQ ID NO: 332 - protein, 15 aa, synthetic construct
  REGION 1..15: note = Sequence of component "B"
EPKSCDKTHTCPPCP

SEQ ID NO: 333 - protein, 12 aa, synthetic construct
  REGION 1..12: note = Sequence of component "B"
ERKCCVECPPCP

SEQ ID NO: 334 - protein, 62 aa, synthetic construct
  REGION 1..62: note = Sequence of component "B"
ELKTPLGDTTHTCPRCPEPKSCDTPPPCPRCPEPKSCDTPPPCPRCPEPKSCDTPPPCPRCP

SEQ ID NO: 335 - protein, 12 aa, synthetic construct
  REGION 1..12: note = Sequence of component "B"
ESKYGPPCPSCP

SEQ ID NO: 336 - protein, 6 aa, synthetic construct
  REGION 1..6: note = Sequence in linker
DKTHTC

SEQ ID NO: 337 - protein, 5 aa, synthetic construct
  REGION 1..5: note = Sequence in adalimumab Fab
CDKTH

SEQ ID NO: 338 - protein, 957 aa, synthetic construct
  REGION 1..957: note = ACE2-740/186/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 339 - protein, 965 aa, synthetic construct
  REGION 1..965: note = ACE2-740/194/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 340 - protein, 972 aa, synthetic construct
  REGION 1..972: note = ACE2-740/201/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 341 - protein, 979 aa, synthetic construct; identical to SEQ ID NO: 69
  REGION 1..979: note = ACE2-740/208/knob/PGLALA/R273Q

SEQ ID NO: 342 - protein, 847 aa, synthetic construct
  REGION 1..847: note = ACE2-615/201/hole/PGLALA/R273Q/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 343 - protein, 848 aa, synthetic construct
  REGION 1..848: note = ACE2-615/202/hole/PGLALA/R273Q/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 344 - protein, 854 aa, synthetic construct
  REGION 1..854: note = ACE2-615/208/hole/PGLALA/R273Q/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 345 - protein, 858 aa, synthetic construct
  REGION 1..858: note = ACE2-615/212/hole/PGLALA/R273Q/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 346 - protein, 859 aa, synthetic construct
  REGION 1..859: note = ACE2-615/213/hole/PGLALA/R273Q/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 347 - protein, 862 aa, synthetic construct
  REGION 1..862: note = ACE2-615/216/hole/PGLALA/R273Q/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSTAPSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 348 - protein, 863 aa, synthetic construct
  REGION 1..863: note = ACE2-615/217/hole/PGLALA/R273Q/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSTAPSTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 349 - protein, 864 aa, synthetic construct
  REGION 1..864: note = ACE2-615/218/hole/PGLALA/R273Q/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSTAPSTSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 350 - protein, 870 aa, synthetic construct
  REGION 1..870: note = ACE2-615/224/hole/PGLALA/R273Q/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSTAPSTSFLLPMGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 351 - protein, 881 aa, synthetic construct
  REGION 1..881: note = ACE2-615/235/hole/PGLALA/R273Q/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSTAPSTSFLLPMGPSPPAEGSTGDDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 352 - protein, 972 aa, synthetic construct
  REGION 1..972: note = ACE2-740/201/hole/PGLALA/R273Q/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 353 - protein, 847 aa, synthetic construct
  REGION 1..847: note = ACE2-615/201/knob/PGLALA/R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 354 - protein, 972 aa, synthetic construct
  REGION 1..972: note = ACE2-740/201/knob/PGLALA
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 355 - protein, 972 aa, synthetic construct
  REGION 1..972: note = ACE2-740/201/knob/PGLALA/R273A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 356 - protein, 972 aa, synthetic construct
  REGION 1..972: note = ACE2-740/201/knob/PGLALA/R273G
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 357 - protein, 972 aa, synthetic construct
  REGION 1..972: note = ACE2-740/201/knob/PGLALA/R273V
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 358 - protein, 972 aa, synthetic construct
  REGION 1..972: note = ACE2-740/201/knob/PGLALA/H378A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 359 - protein, 972 aa, synthetic construct
  REGION 1..972: note = ACE2-740/201/knob/PGLALA/E402A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 360 - protein, 979 aa, synthetic construct
  REGION 1..979: note = ACE2-740/208/knob/PGLALA
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 361 - protein, 979 aa, synthetic construct
  REGION 1..979: note = ACE2-740/208/knob/PGLALA/R273A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 362 - protein, 979 aa, synthetic construct
  REGION 1..979: note = ACE2-740/208/knob/PGLALA/R273G
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 363 - protein, 979 aa, synthetic construct
  REGION 1..979: note = ACE2-740/208/knob/PGLALA/R273V
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 364 - protein, 979 aa, synthetic construct
  REGION 1..979: note = ACE2-740/208/knob/PGLALA/H378A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 365 - protein, 979 aa, synthetic construct
  REGION 1..979: note = ACE2-740/208/knob/PGLALA/E402A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 366 - protein, 847 aa, synthetic construct
  REGION 1..847: note = ACE2-615/201/hole/PGLALA/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 367 - protein, 847 aa, synthetic construct
  REGION 1..847: note = ACE2-615/201/hole/PGLALA/R273A/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 368 - protein, 847 aa, synthetic construct
  REGION 1..847: note = ACE2-615/201/hole/PGLALA/R273G/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 369 - protein, 847 aa, synthetic construct
  REGION 1..847: note = ACE2-615/201/hole/PGLALA/R273V/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 370 - protein, 847 aa, synthetic construct
  REGION 1..847: note = ACE2-615/201/hole/PGLALA/H378A/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 371 - protein, 847 aa, synthetic construct
  REGION 1..847: note = ACE2-615/201/hole/PGLALA/E402A/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 372 - protein, 854 aa, synthetic construct
  REGION 1..854: note = ACE2-615/208/hole/PGLALA/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 373 - protein, 854 aa, synthetic construct
  REGION 1..854: note = ACE2-615/208/hole/PGLALA/R273A/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 374 - protein, 854 aa, synthetic construct
  REGION 1..854: note = ACE2-615/208/hole/PGLALA/R273G/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 375 - protein, 854 aa, synthetic construct
  REGION 1..854: note = ACE2-615/208/hole/PGLALA/R273V/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 376 - protein, 854 aa, synthetic construct
  REGION 1..854: note = ACE2-615/208/hole/PGLALA/H378A/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 377 - protein, 854 aa, synthetic construct
  REGION 1..854: note = ACE2-615/208/hole/PGLALA/E402A/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 378 - protein, 858 aa, synthetic construct
  REGION 1..858: note = ACE2-615/212/hole/PGLALA/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 379 - protein, 858 aa, synthetic construct
  REGION 1..858: note = ACE2-615/212/hole/PGLALA/R273A/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 380 - protein, 858 aa, synthetic construct
  REGION 1..858: note = ACE2-615/212/hole/PGLALA/R273G/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 381 - protein, 858 aa, synthetic construct
  REGION 1..858: note = ACE2-615/212/hole/PGLALA/R273V/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 382 - protein, 858 aa, synthetic construct
  REGION 1..858: note = ACE2-615/212/hole/PGLALA/H378A/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 383 - protein, 858 aa, synthetic construct
  REGION 1..858: note = ACE2-615/212/hole/PGLALA/E402A/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRSQHTQPTPEPSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 384 - protein, 966 aa, synthetic construct
  REGION 1..966: note = ACE2-615/201/hole/PGLALA/RF/TMEM27CA
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADNAFKVRLSIRTALGDKAYAWDTNEEYLFKAMVAFSMRKVPNREATEISHVLLANVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 385 - protein, 966 aa, synthetic construct
  REGION 1..966: note = ACE2-615/201/hole/PGLALA/R273A/RF/TMEM27CA
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADNAFKVRLSIRTALGDKAYAWDTNEEYLFKAMVAFSMRKVPNREATEISHVLLANVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 386 - protein, 966 aa, synthetic construct
  REGION 1..966: note = ACE2-615/201/hole/PGLALA/R273G/RF/TMEM27CA
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADNAFKVRLSIRTALGDKAYAWDTNEEYLFKAMVAFSMRKVPNREATEISHVLLANVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 387 - protein, 966 aa, synthetic construct
  REGION 1..966: note = ACE2-615/201/hole/PGLALA/R273V/RF/TMEM27CA
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADNAFKVRLSIRTALGDKAYAWDTNEEYLFKAMVAFSMRKVPNREATEISHVLLANVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 388 - protein, 966 aa, synthetic construct
  REGION 1..966: note = ACE2-615/201/hole/PGLALA/H378A/RF/TMEM27CA
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADNAFKVRLSIRTALGDKAYAWDTNEEYLFKAMVAFSMRKVPNREATEISHVLLANVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 389 - protein, 966 aa, synthetic construct
  REGION 1..966: note = ACE2-615/201/hole/PGLALA/E402A/RF/TMEM27CA
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADNAFKVRLSIRTALGDKAYAWDTNEEYLFKAMVAFSMRKVPNREATEISHVLLANVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 390 - protein, 966 aa, synthetic construct
  REGION 1..966: note = ACE2-607/201/hole/PGLALA/RF/TMEM27
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 391 - protein, 966 aa, synthetic construct
  REGION 1..966: note = ACE2-607/201/hole/PGLALA/R273A/RF/TMEM27
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 392 - protein, 966 aa, synthetic construct
  REGION 1..966: note = ACE2-607/201/hole/PGLALA/R273G/RF/TMEM27
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 393 - protein, 966 aa, synthetic construct
  REGION 1..966: note = ACE2-607/201/hole/PGLALA/R273V/RF/TMEM27
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 394 - protein, 966 aa, synthetic construct
  REGION 1..966: note = ACE2-607/201/hole/PGLALA/H378A/RF/TMEM27
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 395 - protein, 966 aa, synthetic construct
  REGION 1..966: note = ACE2-607/201/hole/PGLALA/E402A/RF/TMEM27
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 396 - protein, 970 aa, synthetic construct
  REGION 1..970: note = ACE2-611/201/hole/PGLALA/RF/TMEM27
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 397 - protein, 970 aa, synthetic construct
  REGION 1..970: note = ACE2-611/201/hole/PGLALA/R273A/RF/TMEM27
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 398 - protein, 970 aa, synthetic construct
  REGION 1..970: note = ACE2-611/201/hole/PGLALA/R273G/RF/TMEM27
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 399 - protein, 970 aa, synthetic construct
  REGION 1..970: note = ACE2-611/201/hole/PGLALA/R273V/RF/TMEM27
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 400 - protein, 970 aa, synthetic construct
  REGION 1..970: note = ACE2-611/201/hole/PGLALA/H378A/RF/TMEM27
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 401 - protein, 970 aa, synthetic construct
  REGION 1..970: note = ACE2-611/201/hole/PGLALA/E402A/RF/TMEM27
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 402 - protein, 972 aa, synthetic construct
  REGION 1..972: note = ACE2-740/201/PGLALA
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 403 - protein, 972 aa, synthetic construct
  REGION 1..972: note = ACE2-740/201/PGLALA/R273A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 404 - protein, 972 aa, synthetic construct
  REGION 1..972: note = ACE2-740/201/PGLALA/R273G
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 405 - protein, 972 aa, synthetic construct
  REGION 1..972: note = ACE2-740/201/PGLALA/R273V
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 406 - protein, 972 aa, synthetic construct
  REGION 1..972: note = ACE2-740/201/PGLALA/H378A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 407 - protein, 972 aa, synthetic construct
  REGION 1..972: note = ACE2-740/201/PGLALA/E402A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 408 - protein, 972 aa, synthetic construct
  REGION 1..972: note = ACE2-740/201/PGLALA/313
QSTIEEQAKTFLDFFDSQAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 409 - protein, 972 aa, synthetic construct
  REGION 1..972: note = ACE2-740/201/PGLALA/R273A/313
QSTIEEQAKTFLDFFDSQAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 410 - protein, 972 aa, synthetic construct
  REGION 1..972: note = ACE2-740/201/PGLALA/R273G/313
QSTIEEQAKTFLDFFDSQAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 411 - protein, 972 aa, synthetic construct
  REGION 1..972: note = ACE2-740/201/PGLALA/R273V/313
QSTIEEQAKTFLDFFDSQAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 412 - protein, 972 aa, synthetic construct
  REGION 1..972: note = ACE2-740/201/PGLALA/H378A/313
QSTIEEQAKTFLDFFDSQAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 413 - protein, 972 aa, synthetic construct
  REGION 1..972: note = ACE2-740/201/PGLALA/E402A/313
QSTIEEQAKTFLDFFDSQAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 414 - protein, 979 aa, synthetic construct
  REGION 1..979: note = ACE2-740/208/knob/PGLALA/313
QSTIEEQAKTFLDFFDSQAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 415 - protein, 979 aa, synthetic construct
  REGION 1..979: note = ACE2-740/208/knob/PGLALA/R273A/313
QSTIEEQAKTFLDFFDSQAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 416 - protein, 979 aa, synthetic construct
  REGION 1..979: note = ACE2-740/208/knob/PGLALA/R273G/313
QSTIEEQAKTFLDFFDSQAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 417 - protein, 979 aa, synthetic construct
  REGION 1..979: note = ACE2-740/208/knob/PGLALA/R273V/313
QSTIEEQAKTFLDFFDSQAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 418 - protein, 979 aa, synthetic construct
  REGION 1..979: note = ACE2-740/208/knob/PGLALA/H378A/313
QSTIEEQAKTFLDFFDSQAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 419 - protein, 979 aa, synthetic construct
  REGION 1..979: note = ACE2-740/208/knob/PGLALA/E402A/313
QSTIEEQAKTFLDFFDSQAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRSQHTQPTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 420 - protein, 221 aa, synthetic construct; identical to SEQ ID NO: 73
  REGION 1..221: note = Fc6CC-hole/PGLALA/RF

SEQ ID NO: 421 - protein, 110 aa, synthetic construct
  REGION 1..110: note = REGN10987_VL (PDB:6XDG_A)
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLTVL

SEQ ID NO: 422 - protein, 120 aa, synthetic construct
  REGION 1..120: note = REGN10987_VH (PDB:6XDG_C)
QVQLVESGGGVVQPGRSLRLSCAASGFTFSNYAMYWVRQAPGKGLEWVAVISYDGSNKYYADSVKGRFTISRDNSKNTLYLQMNSLRTEDTAVYYCASGSDYGDYLLVYWGQGTLVTVSS

SEQ ID NO: 423 - protein, 216 aa, synthetic construct
  REGION 1..216: note = REGN10987_VL-CL
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 424 - protein, 449 aa, synthetic construct
  REGION 1..449: note = REGN10987_VH-CH
QVQLVESGGGVVQPGRSLRLSCAASGFTFSNYAMYWVRQAPGKGLEWVAVISYDGSNKYYADSVKGRFTISRDNSKNTLYLQMNSLRTEDTAVYYCASGSDYGDYLLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 425 - protein, 449 aa, synthetic construct
  REGION 1..449: note = REGN10987_VH-CH/hole/PGLALA/RF/N82aS
QVQLVESGGGVVQPGRSLRLSCAASGFTFSNYAMYWVRQAPGKGLEWVAVISYDGSNKYYADSVKGRFTISRDNSKNTLYLQMSSLRTEDTAVYYCASGSDYGDYLLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 426 - protein, 605 aa, synthetic construct
  REGION 1..605: note = REGN10987_VH-CH/CLD201/knob/PGLALA
QVQLVESGGGVVQPGRSLRLSCAASGFTFSNYAMYWVRQAPGKGLEWVAVISYDGSNKYYADSVKGRFTISRDNSKNTLYLQMNSLRTEDTAVYYCASGSDYGDYLLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 427 - protein, 107 aa, synthetic construct
  REGION 1..107: note = REGN10933_VK (PDB:6XDG_D)
DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIK

SEQ ID NO: 428 - protein, 120 aa, synthetic construct
  REGION 1..120: note = REGN10933_VH (PDB:6XDG_B)
QVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSS

SEQ ID NO: 429 - protein, 214 aa, synthetic construct
  REGION 1..214: note = REGN10933_VK-CK
DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 430 - protein, 449 aa, synthetic construct
  REGION 1..449: note = REGN10933_VH-CH
QVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 431 - protein, 449 aa, synthetic construct
  REGION 1..449: note = REGN10933_VH-CH/hole/PGLALA/RF/N82aS
QVQLVESGGGLVKPGGSLRLSCAASGFTFSDYYMSWIRQAPGKGLEWVSYITYSGSTIYYADSVKGRFTISRDNAKSSLYLQMSSLRAEDTAVYYCARDRGTTMVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 432 - protein, 605 aa, synthetic construct
  REGION 1..605: note = REGN10933_VH-CH/CLD201/knob/PGLALA
QVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 433 - protein, 107 aa, synthetic construct [sequence omitted]

SEQ ID NO: 434 - protein, 127 aa, synthetic construct [sequence omitted]

SEQ ID NO: 435 - protein, 214 aa, synthetic construct
  REGION 1..214: note = S309_VK-CK
EIVLTQSPGTLSLSPGERATLSCRASQTVSSTSLAWYQQKPGQAPRLLIYGASSRATGIPDRFSGSGSGTDFTLTISRLEPEDFAVYYCQQHDTSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 436 - protein, 456 aa, synthetic construct
  REGION 1..456: note = S309_VH-CH
QVQLVQSGAEVKKPGASVKVSCKASGYPFTSYGISWVRQAPGQGLEWMGWISTYNGNTNYAQKFQGRVTMTTDTSTTTGYMELRRLRSDDTAVYYCARDYTRGAWFGESLIGGFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 437 - protein, 456 aa, synthetic construct
  REGION 1..456: note = S309_VH-CH/hole/PGLALA/RF
QVQLVQSGAEVKKPGASVKVSCKASGYPFTSYGISWVRQAPGQGLEWMGWISTYNGNTNYAQKFQGRVTMTTDTSTTTGYMELRRLRSDDTAVYYCARDYTRGAWFGESLIGGFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 438 - protein, 612 aa, synthetic construct
  REGION 1..612: note = S309_VH-CH/CLD201/knob/PGLALA
QVQLVQSGAEVKKPGASVKVSCKASGYPFTSYGISWVRQAPGQGLEWMGWISTYNGNTNYAQKFQGRVTMTTDTSTTTGYMELRRLRSDDTAVYYCARDYTRGAWFGESLIGGFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 439 - protein, 107 aa, synthetic construct
  REGION 1..107: note = Bamlanivimab_11876_VK
DIQMTQSPSSLSASVGDRVTITCRASQSISSYLSWYQQKPGKAPKLLIYAASSLQSGVPSRFSGSGSGTDFTLTITSLQPEDFATYYCQQSYSTPRTFGQGTKVEIK

SEQ ID NO: 440 - protein, 125 aa, synthetic construct
  REGION 1..125: note = Bamlanivimab_11876_VH
QVQLVQSGAEVKKPGSSVKVSCKASGGTFSNYAISWVRQAPGQGLEWMGRIIPILGIANYAQKFQGRVTITADKSTSTAYMELSSLRSEDTAVYYCARGYYEARHYYYYYAMDVWGQGTAVTVSS

SEQ ID NO: 441 - protein, 214 aa, synthetic construct
  REGION 1..214: note = Bamlanivimab_11876_VK-CK
DIQMTQSPSSLSASVGDRVTITCRASQSISSYLSWYQQKPGKAPKLLIYAASSLQSGVPSRFSGSGSGTDFTLTITSLQPEDFATYYCQQSYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 442 - protein, 454 aa, synthetic construct
  REGION 1..454: note = Bamlanivimab_11876_VH-CH
QVQLVQSGAEVKKPGSSVKVSCKASGGTFSNYAISWVRQAPGQGLEWMGRIIPILGIANYAQKFQGRVTITADKSTSTAYMELSSLRSEDTAVYYCARGYYEARHYYYYYAMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 443 - protein, 109 aa, synthetic construct
  REGION 1..109: note = Etesevimab_11873_VK
DIVMTQSPSSLSASVGDRVTITCRASQSISRYLNWYQQKPGKAPKLLIYAASSLQSGVPSRFSGSGSGTDFTLTISSLQPEDFATYYCQQSYSTPPEYTFGQGTKLEIK

SEQ ID NO: 444 - protein, 119 aa, synthetic construct
  REGION 1..119: note = Etesevimab_11873_VH
EVQLVESGGGLVQPGGSLRLSCAASGFTVSSNYMSWVRQAPGKGLEWVSVIYSGGSTFYADSVKGRFTISRDNSMNTLFLQMNSLRAEDTAVYYCARVLPMYGDYLDYWGQGTLVTVSS

SEQ ID NO: 445 - protein, 216 aa, synthetic construct
  REGION 1..216: note = Etesevimab_11873_VK-CK
DIVMTQSPSSLSASVGDRVTITCRASQSISRYLNWYQQKPGKAPKLLIYAASSLQSGVPSRFSGSGSGTDFTLTISSLQPEDFATYYCQQSYSTPPEYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 446 - protein, 448 aa, synthetic construct
  REGION 1..448: note = Etesevimab_11873_VH-CH
EVQLVESGGGLVQPGGSLRLSCAASGFTVSSNYMSWVRQAPGKGLEWVSVIYSGGSTFYADSVKGRFTISRDNSMNTLFLQMNSLRAEDTAVYYCARVLPMYGDYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 447 - protein, 112 aa, synthetic construct
  REGION 1..112: note = Cilgavimab_11777_VK
DIVMTQSPDSLAVSLGERATINCKSSQSVLYSSNNKNYLAWYQQKPGQPPKLLMYWASTRESGVPDRFSGSGSGAEFTLTISSLQAEDVAIYYCQQYYSTLTFGGGTKVEIK

SEQ ID NO: 448 - protein, 131 aa, synthetic construct
  REGION 1..131: note = Cilgavimab_11777_VH
EVQLVESGGGLVKPGGSLRLSCAASGFTFRDVWMSWVRQAPGKGLEWVGRIKSKIDGGTTDYAAPVKGRFTISRDDSKNTLYLQMNSLKTEDTAVYYCTTAGSYYYDTVGPGLPEGKFDYWGQGTLVTVSS

SEQ ID NO: 449 - protein, 219 aa, synthetic construct
  REGION 1..219: note = Cilgavimab_11777_VK-CK
DIVMTQSPDSLAVSLGERATINCKSSQSVLYSSNNKNYLAWYQQKPGQPPKLLMYWASTRESGVPDRFSGSGSGAEFTLTISSLQAEDVAIYYCQQYYSTLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 450 - protein, 460 aa, synthetic construct
  REGION 1..460: note = Cilgavimab_11777_VH-CH
EVQLVESGGGLVKPGGSLRLSCAASGFTFRDVWMSWVRQAPGKGLEWVGRIKSKIDGGTTDYAAPVKGRFTISRDDSKNTLYLQMNSLKTEDTAVYYCTTAGSYYYDTVGPGLPEGKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 451 - protein, 109 aa, synthetic construct
  REGION 1..109: note = Tixagevimab_11776_VK
EIVLTQSPGTLSLSPGERATLSCRASQSVSSSYLAWYQQKPGQAPRLLIYGASSRATGIPDRFSGSGSGTDFTLTISRLEPEDFAVYYCQHYGSSRGWTFGQGTKVEIK

SEQ ID NO: 452 - protein, 123 aa, synthetic construct
  REGION 1..123: note = Tixagevimab_11776_VH
QMQLVQSGPEVKKPGTSVKVSCKASGFTFMSSAVQWVRQARGQRLEWIGWIVIGSGNTNYAQKFQERVTITRDMSTSTAYMELSSLRSEDTAVYYCAAPYCSSISCNDGFDIWGQGTMVTVSS

SEQ ID NO: 453 - protein, 216 aa, synthetic construct
  REGION 1..216: note = Tixagevimab_11776_VK-CK
EIVLTQSPGTLSLSPGERATLSCRASQSVSSSYLAWYQQKPGQAPRLLIYGASSRATGIPDRFSGSGSGTDFTLTISRLEPEDFAVYYCQHYGSSRGWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 454 - protein, 452 aa, synthetic construct
  REGION 1..452: note = Tixagevimab_11776_Vh-CH
QMQLVQSGPEVKKPGTSVKVSCKASGFTFMSSAVQWVRQARGQRLEWIGWIVIGSGNTNYAQKFQERVTITRDMSTSTAYMELSSLRSEDTAVYYCAAPYCSSISCNDGFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 455 - protein, 107 aa, synthetic construct [sequence omitted]

SEQ ID NO: 456 - protein, 127 aa, synthetic construct
  REGION 1..127: note = Sotrovimab_s309_VH
QVQLVQSGAEVKKPGASVKVSCKASGYPFTSYGISWVRQAPGQGLEWMGWISTYQGNTNYAQKFQGRVTMTTDTSTTTGYMELRRLRSDDTAVYYCARDYTRGAWFGESLIGGFDNWGQGTLVTVSS

SEQ ID NO: 457 - protein, 214 aa, synthetic construct; identical to SEQ ID NO: 435
  REGION 1..214: note = Sotrovimab_s309_VK-CK

SEQ ID NO: 458 - protein, 456 aa, synthetic construct
  REGION 1..456: note = Sotrovimab_s309_VH-CH
QVQLVQSGAEVKKPGASVKVSCKASGYPFTSYGISWVRQAPGQGLEWMGWISTYQGNTNYAQKFQGRVTMTTDTSTTTGYMELRRLRSDDTAVYYCARDYTRGAWFGESLIGGFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 459 - protein, 110 aa, synthetic construct
  REGION 1..110: note = Regdanvimab_11883_VL
ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVL

SEQ ID NO: 460 - protein, 128 aa, synthetic construct
  REGION 1..128: note = Regdanvimab_11883_VH
QITLKESGPTLVKPTQTLTLTCSFSGFSLSTSGVGVGWIRQPPGKALEWLALIDWDDNKYHTTSLKTRLTISKDTSKNQVVLTMTNMDPVDTATYYCARIPGFLRYRNRYYYYGMDVWGQGTTVTVSS

SEQ ID NO: 461 - protein, 216 aa, synthetic construct
  REGION 1..216: note = Regdanvimab_11883_VL-CL
ELVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTELTVLGQPKAAPSVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 462 - protein, 457 aa, synthetic construct
  REGION 1..457: note = Regdanvimab_11883_VH-CH
QITLKESGPTLVKPTQTLTLTCSFSGFSLSTSGVGVGWIRQPPGKALEWLALIDWDDNKYHTTSLKTRLTISKDTSKNQVVLTMTNMDPVDTATYYCARIPGFLRYRNRYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 463 - protein, 107 aa, synthetic construct
  REGION 1..107: note = B13A_VK
DIQMTQTTSSLSASLGDRVTISCRASQDISNYLNWYQQKPDGTVKLLIYYTSRLQSGVPSRFSGSGTGTDYSLTISNLEQEDIATYFCQQGNTLPWTFGGGTKLEIK

SEQ ID NO: 464 - protein, 121 aa, synthetic construct
  REGION 1..121: note = B13A_VH
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSS

SEQ ID NO: 465 - protein, 214 aa, synthetic construct
  REGION 1..214: note = B13A_VK-CK
DIQMTQTTSSLSASLGDRVTISCRASQDISNYLNWYQQKPDGTVKLLIYYTSRLQSGVPSRFSGSGTGTDYSLTISNLEQEDIATYFCQQGNTLPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 466 - protein, 450 aa, synthetic construct
  REGION 1..450: note = B13A_VH-CH/PGLALA
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 467 - protein, 111 aa, synthetic construct
  REGION 1..111: note = O24A_VK
DIVLTQSPASLAVFLGQRATISCRASKSVSTSGYSYMHWYQQRPGQPPKLLIYLASNLESGVPARFSGSGSGTDFTLNIHPVEEEDAATYYCQHSRELPPTFGGGTKLEIK

SEQ ID NO: 468 - protein, 118 aa, synthetic construct
  REGION 1..118: note = O24A_VH
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSS

SEQ ID NO: 469 - protein, 218 aa, synthetic construct
  REGION 1..218: note = O24A_VK-CK
DIVLTQSPASLAVFLGQRATISCRASKSVSTSGYSYMHWYQQRPGQPPKLLIYLASNLESGVPARFSGSGSGTDFTLNIHPVEEEDAATYYCQHSRELPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 470 - protein, 447 aa, synthetic construct
  REGION 1..447: note = O24A_VH-CH/PGLALA
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 471 - protein, 991 aa, synthetic construct
  REGION 1..991: note = ACE2-740wt/201/hole/PGLALA/RF
MEWSWVFLFFLSVTTGVHSQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 472 - protein, 468 aa, synthetic construct
  REGION 1..468: note = REGN10987_VH/knob/PGLALA
MEWSWVFLFFLSVTTGVHSQVQLVESGGGVVQPGRSLRLSCAASGFTFSNYAMYWVRQAPGKGLEWVAVISYDGSNKYYADSVKGRFTISRDNSKNTLYLQMNSLRTEDTAVYYCASGSDYGDYLLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 473 - protein, 991 aa, synthetic construct
  REGION 1..991: note = ACE2-740HA/201/hole/PGLALA/RF
MEWSWVFLFFLSVTTGVHSQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 474 - protein, 468 aa, synthetic construct
  REGION 1..468: note = REGN10933_VH/knob/PGLALA
MEWSWVFLFFLSVTTGVHSQVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 475 - protein, 473 aa, synthetic construct
  REGION 1..473: note = Bamlanivimab_11876_VH/knob/PGLALA
MEWSWVFLFFLSVTTGVHSQVQLVQSGAEVKKPGSSVKVSCKASGGTFSNYAISWVRQAPGQGLEWMGRIIPILGIANYAQKFQGRVTITADKSTSTAYMELSSLRSEDTAVYYCARGYYEARHYYYYYAMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 476 - protein, 467 aa, synthetic construct
  REGION 1..467: note = Etesevimab_11873_VH/knob/PGLALA
MEWSWVFLFFLSVTTGVHSEVQLVESGGGLVQPGGSLRLSCAASGFTVSSNYMSWVRQAPGKGLEWVSVIYSGGSTFYADSVKGRFTISRDNSMNTLFLQMNSLRAEDTAVYYCARVLPMYGDYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 477 - protein, 991 aa, synthetic construct
  REGION 1..991: note = ACE2-740wt/201/hole/FES/YTE/RF
MEWSWVFLFFLSVTTGVHSQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEFEGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 478 - protein, 479 aa, synthetic construct
  REGION 1..479: note = Cilgavimab_11777_VH/knob/FES/YTE
MEWSWVFLFFLSVTTGVHSEVQLVESGGGLVKPGGSLRLSCAASGFTFRDVWMSWVRQAPGKGLEWVGRIKSKIDGGTTDYAAPVKGRFTISRDDSKNTLYLQMNSLKTEDTAVYYCTTAGSYYYDTVGPGLPEGKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFEGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 479 - protein, 991 aa, synthetic construct
  REGION 1..991: note = ACE2-740HA/201/hole/FES/YTE/RF
MEWSWVFLFFLSVTTGVHSQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEFEGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 480 - protein, 471 aa, synthetic construct
  REGION 1..471: note = Tixagevimab_11776_VH/knob/FES/YTE
MEWSWVFLFFLSVTTGVHSQMQLVQSGPEVKKPGTSVKVSCKASGFTFMSSAVQWVRQARGQRLEWIGWIVIGSGNTNYAQKFQERVTITRDMSTSTAYMELSSLRSEDTAVYYCAAPYCSSISCNDGFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFEGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 481 - protein, 991 aa, synthetic construct
  REGION 1..991: note = ACE2-740wt/201/hole/PGLALA/RF/LS
MEWSWVFLFFLSVTTGVHSQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVLHEALHSRFTQKSLSLSPG

SEQ ID NO: 482 - protein, 475 aa, synthetic construct
  REGION 1..475: note = Sotrovimab_11766_VH/knob/PGLALA/LS
MEWSWVFLFFLSVTTGVHSQVQLVQSGAEVKKPGASVKVSCKASGYPFTSYGISWVRQAPGQGLEWMGWISTYQGNTNYAQKFQGRVTMTTDTSTTTGYMELRRLRSDDTAVYYCARDYTRGAWFGESLIGGFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 483 - protein, 991 aa, synthetic construct
  REGION 1..991: note = ACE2-740HA/201/hole/PGLALA/RF/LS
MEWSWVFLFFLSVTTGVHSQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVLHEALHSRFTQKSLSLSPG

SEQ ID NO: 484 - protein, 476 aa, synthetic construct
  REGION 1..476: note = Regdanvimab_11883_VH/knob/PGLALA
MEWSWVFLFFLSVTTGVHSQITLKESGPTLVKPTQTLTLTCSFSGFSLSTSGVGVGWIRQPPGKALEWLALIDWDDNKYHTTSLKTRLTISKDTSKNQVVLTMTNMDPVDTATYYCARIPGFLRYRNRYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 485 - protein, 469 aa, synthetic construct
  REGION 1..469: note = B13A_VH/knob/PGLALA
MEWSWVFLFFLSVTTGVHSQVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 486 - protein, 466 aa, synthetic construct
  REGION 1..466: note = O24A_VH/knob/PGLALA
MEWSWVFLFFLSVTTGVHSQAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 487 - protein, 469 aa, synthetic construct
  REGION 1..469: note = B13A_VH/knob/FES/YTE
MEWSWVFLFFLSVTTGVHSQVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFEGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 488 - protein, 466 aa, synthetic construct
  REGION 1..466: note = O24A_VH/knob/FES/YTE
MEWSWVFLFFLSVTTGVHSQAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFEGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 489 - protein, 605 aa, synthetic construct
  REGION 1..605: note = REGN10987_VH/CLD201/hole/PGLALA/RF/N84S
QVQLVESGGGVVQPGRSLRLSCAASGFTFSNYAMYWVRQAPGKGLEWVAVISYDGSNKYYADSVKGRFTISRDNSKNTLYLQMSSLRTEDTAVYYCASGSDYGDYLLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 490 - protein, 598 aa, synthetic construct
  REGION 1..598: note = REGN10987_(x)VL/CLD201/hole/PGLALA/RF
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 491 - protein, 605 aa, synthetic construct
  REGION 1..605: note = REGN10933_VH/CLD201/hole/PGLALA/RF/N84S
QVQLVESGGGLVKPGGSLRLSCAASGFTFSDYYMSWIRQAPGKGLEWVSYITYSGSTIYYADSVKGRFTISRDNAKSSLYLQMSSLRAEDTAVYYCARDRGTTMVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 492 - protein, 596 aa, synthetic construct
  REGION 1..596: note = REGN10933_(x)VK/CLD201/hole/PGLALA/RF
DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 493 - protein, 610 aa, synthetic construct
  REGION 1..610: note = 11876_VH/CLD201/hole/PGLALA/RF/N82aS)
QVQLVQSGAEVKKPGSSVKVSCKASGGTFSNYAISWVRQAPGQGLEWMGRIIPILGIANYAQKFQGRVTITADKSTSTAYMELSSLRSEDTAVYYCARGYYEARHYYYYYAMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 494 - protein, 596 aa, synthetic construct
  REGION 1..596: note = 11876_(x)VK/CLD201/hole/PGLALA/RF
DIQMTQSPSSLSASVGDRVTITCRASQSISSYLSWYQQKPGKAPKLLIYAASSLQSGVPSRFSGSGSGTDFTLTITSLQPEDFATYYCQQSYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 495 - protein, 604 aa, synthetic construct
  REGION 1..604: note = 11873_VH/CLD201/hole/PGLALA/RF/N83S
EVQLVESGGGLVQPGGSLRLSCAASGFTVSSNYMSWVRQAPGKGLEWVSVIYSGGSTFYADSVKGRFTISRDNSMNTLFLQMSSLRAEDTAVYYCARVLPMYGDYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 496 - protein, 598 aa, synthetic construct
  REGION 1..598: note = 11873_(x)VK/CLD201/hole/PGLALA/RF
DIVMTQSPSSLSASVGDRVTITCRASQSISRYLNWYQQKPGKAPKLLIYAASSLQSGVPSRFSGSGSGTDFTLTISSLQPEDFATYYCQQSYSTPPEYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 497 - protein, 616 aa, synthetic construct
  REGION 1..616: note = 11777_VH/CLD201/hole/FES/YTE/RF/N86S
EVQLVESGGGLVKPGGSLRLSCAASGFTFRDVWMSWVRQAPGKGLEWVGRIKSKIDGGTTDYAAPVKGRFTISRDDSKNTLYLQMSSLKTEDTAVYYCTTAGSYYYDTVGPGLPEGKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEFEGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 498 - protein, 601 aa, synthetic construct
  REGION 1..601: note = 11777_(x)VK/CLD201/hole/FES/YTE/RF
DIVMTQSPDSLAVSLGERATINCKSSQSVLYSSNNKNYLAWYQQKPGQPPKLLMYWASTRESGVPDRFSGSGSGAEFTLTISSLQAEDVAIYYCQQYYSTLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEFEGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 499 - protein, 608 aa, synthetic construct
  REGION 1..608: note = 11776_VH/CLD201/hole/FES/YTE/RF
QMQLVQSGPEVKKPGTSVKVSCKASGFTFMSSAVQWVRQARGQRLEWIGWIVIGSGNTNYAQKFQERVTITRDMSTSTAYMELSSLRSEDTAVYYCAAPYCSSISCNDGFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEFEGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 500 - protein, 598 aa, synthetic construct
  REGION 1..598: note = 11776_xVK/CLD201/hole/FES/YTE/RF
EIVLTQSPGTLSLSPGERATLSCRASQSVSSSYLAWYQQKPGQAPRLLIYGASSRATGIPDRFSGSGSGTDFTLTISRLEPEDFAVYYCQHYGSSRGWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEFEGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 501 - protein, 612 aa, synthetic construct
  REGION 1..612: note = 11766_VH/CLD201/hole/PGLALA/RF/LS
QVQLVQSGAEVKKPGASVKVSCKASGYPFTSYGISWVRQAPGQGLEWMGWISTYQGNTNYAQKFQGRVTMTTDTSTTTGYMELRRLRSDDTAVYYCARDYTRGAWFGESLIGGFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVLHEALHSRFTQKSLSLSPG

SEQ ID NO: 502 - protein, 613 aa, synthetic construct
  REGION 1..613: note = 11883_VH/CLD201/hole/PGLALA/RF
QITLKESGPTLVKPTQTLTLTCSFSGFSLSTSGVGVGWIRQPPGKALEWLALIDWDDNKYHTTSLKTRLTISKDTSKNQVVLTMTNMDPVDTATYYCARIPGFLRYRNRYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 503 - protein, 223 aa, synthetic construct
  REGION 1..223: note = REGN10987_(x)VH/N84S
QVQLVESGGGVVQPGRSLRLSCAASGFTFSNYAMYWVRQAPGKGLEWVAVISYDGSNKYYADSVKGRFTISRDNSKNTLYLQMSSLRTEDTAVYYCASGSDYGDYLLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 504 - protein, 223 aa, synthetic construct
  REGION 1..223: note = REGN10933_(x)VH/N84S
QVQLVESGGGLVKPGGSLRLSCAASGFTFSDYYMSWIRQAPGKGLEWVSYITYSGSTIYYADSVKGRFTISRDNAKSSLYLQMSSLRAEDTAVYYCARDRGTTMVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 505 - protein, 228 aa, synthetic construct
  REGION 1..228: note = 11876_(x)VH
QVQLVQSGAEVKKPGSSVKVSCKASGGTFSNYAISWVRQAPGQGLEWMGRIIPILGIANYAQKFQGRVTITADKSTSTAYMELSSLRSEDTAVYYCARGYYEARHYYYYYAMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 506 - protein, 222 aa, synthetic construct
  REGION 1..222: note = 11873_(x)VH/N83S
EVQLVESGGGLVQPGGSLRLSCAASGFTVSSNYMSWVRQAPGKGLEWVSVIYSGGSTFYADSVKGRFTISRDNSMNTLFLQMSSLRAEDTAVYYCARVLPMYGDYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 507 - protein, 234 aa, synthetic construct
  REGION 1..234: note = 11777_(x)VH/N86S
EVQLVESGGGLVKPGGSLRLSCAASGFTFRDVWMSWVRQAPGKGLEWVGRIKSKIDGGTTDYAAPVKGRFTISRDDSKNTLYLQMSSLKTEDTAVYYCTTAGSYYYDTVGPGLPEGKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 508 - protein, 226 aa, synthetic construct
  REGION 1..226: note = 11776_xVH
QMQLVQSGPEVKKPGTSVKVSCKASGFTFMSSAVQWVRQARGQRLEWIGWIVIGSGNTNYAQKFQERVTITRDMSTSTAYMELSSLRSEDTAVYYCAAPYCSSISCNDGFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 509 - protein, 972 aa, synthetic construct; identical to SEQ ID NO: 358
  REGION 1..972: note = ACE2-740HA/201/knob/PGLALA

SEQ ID NO: 510 - protein, 847 aa, synthetic construct; identical to SEQ ID NO: 370
  REGION 1..847: note = ACE2-615HA/201/hole/PGLALA/RF

SEQ ID NO: 511 - protein, 847 aa, synthetic construct
  REGION 1..847: note = ACE2-615HA/201/knob/PGLALA
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 512 - protein, 972 aa, synthetic construct
  REGION 1..972: note = ACE2-740HA/201/knob/PGLALA/YTE
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 513 - protein, 847 aa, synthetic construct
  REGION 1..847: note = ACE2-615HA/201/hole/PGLALA/YTE/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 514 - protein, 972 aa, synthetic construct
  REGION 1..972: note = ACE2-740HA/201/hole/PGLALA/YTE/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 515 - protein, 847 aa, synthetic construct
  REGION 1..847: note = ACE2-615HA/201/knob/PGLALA/YTE
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 516 - protein, 972 aa, synthetic construct
  REGION 1..972: note = ACE2-740HA/201/knob/PGLALA/LS
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 517 - protein, 847 aa, synthetic construct
  REGION 1..847: note = ACE2-615HA/201/hole/PGLALA/LS/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVLHEALHSRFTQKSLSLSPG

SEQ ID NO: 518 - protein, 972 aa, synthetic construct
  REGION 1..972: note = ACE2-740HA/201/hole/PGLALA/LS/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVLHEALHSRFTQKSLSLSPG

SEQ ID NO: 519 - protein, 847 aa, synthetic construct
  REGION 1..847: note = ACE2-615HA/201/knob/PGLALA/LS
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 520 - protein, 972 aa, synthetic construct
  REGION 1..972: note = ACE2-740HA/201/knob/PGLALA/DHS
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 521 - protein, 847 aa, synthetic construct
  REGION 1..847: note = ACE2-615HA/201/hole/PGLALA/DHS/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 522 - protein, 972 aa, synthetic construct
  REGION 1..972: note = ACE2-740HA/201/hole/PGLALA/DHS/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 523 - protein, 847 aa, synthetic construct
  REGION 1..847: note = ACE2-615HA/201/knob/PGLALA/DHS
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 524 - protein, 972 aa, synthetic construct
  REGION 1..972: note = ACE2-740HA/201/hole/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 525 - protein, 450 aa, synthetic construct
  REGION 1..450: note = B13A_VH/knob
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 526 - protein, 972 aa, synthetic construct
  REGION 1..972: note = ACE2-740HA/201/hole/YTE/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 527 - protein, 450 aa, synthetic construct
  REGION 1..450: note = B13A_VH/knob/YTE
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 528 - protein, 450 aa, synthetic construct
  REGION 1..450: note = B13A_VH/knob/PGLALA/YTE
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 529 - protein, 972 aa, synthetic construct
  REGION 1..972: note = ACE2-740HA/201/hole/LS/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVLHEALHSRFTQKSLSLSPG

SEQ ID NO: 530 - protein, 450 aa, synthetic construct
  REGION 1..450: note = B13A_VH/knob/LS
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 531 - protein, 450 aa, synthetic construct
  REGION 1..450: note = B13A_VH/knob/PGLALA/LS
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 532 - protein, 972 aa, synthetic construct
  REGION 1..972: note = ACE2-740HA/201/hole/DHS/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 533 - protein, 450 aa, synthetic construct
  REGION 1..450: note = B13A_VH/knob/DHS
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 534 - protein, 450 aa, synthetic construct
  REGION 1..450: note = B13A_VH/knob/PGLALA/DHS
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 535 - protein, 447 aa, synthetic construct
  REGION 1..447: note = O24A_VH/knob
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 536 - protein, 447 aa, synthetic construct
  REGION 1..447: note = O24A_VH/knob/YTE
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 537 - protein, 447 aa, synthetic construct
  REGION 1..447: note = O24A_VH/knob/PGLALA/YTE
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 538 - protein, 447 aa, synthetic construct
  REGION 1..447: note = O24A_VH/knob/LS
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 539 - protein, 447 aa, synthetic construct
  REGION 1..447: note = O24A_VH/knob/PGLALA/LS
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 540 - protein, 447 aa, synthetic construct
  REGION 1..447: note = O24A_VH/knob/DHS
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 541 - protein, 447 aa, synthetic construct
  REGION 1..447: note = O24A_VH/knob/PGLALA/DHS
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 542 - protein, 972 aa, synthetic construct
  REGION 1..972: note = ACE2-740HA/201/knob
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 543 - protein, 847 aa, synthetic construct
  REGION 1..847: note = ACE2-615HA/201/hole/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 544 - protein, 847 aa, synthetic construct
  REGION 1..847: note = ACE2-615HA/201/knob
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 545 - protein, 972 aa, synthetic construct
  REGION 1..972: note = ACE2-740HA/201/knob/YTE
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 546 - protein, 847 aa, synthetic construct
  REGION 1..847: note = ACE2-615HA/201/hole/YTE/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 547 - protein, 847 aa, synthetic construct
  REGION 1..847: note = ACE2-615HA/201/knob/YTE
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 548 - protein, 972 aa, synthetic construct
  REGION 1..972: note = ACE2-740HA/201/knob/LS
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 549 - protein, 847 aa, synthetic construct
  REGION 1..847: note = ACE2-615HA/201/hole/LS/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVLHEALHSRFTQKSLSLSPG

SEQ ID NO: 550 - protein, 847 aa, synthetic construct
  REGION 1..847: note = ACE2-615HA/201/knob/LS
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 551 - protein, 972 aa, synthetic construct
  REGION 1..972: note = ACE2-740HA/201/knob/DHS
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 552 - protein, 847 aa, synthetic construct
  REGION 1..847: note = ACE2-615HA/201/hole/DHS/RF
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 553 - protein, 847 aa, synthetic construct
  REGION 1..847: note = ACE2-615HA/201/knob/DHS
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 554 - protein, 450 aa, synthetic construct
  REGION 1..450: note = B13A_VH-CH/wt
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 555 - protein, 447 aa, synthetic construct
  REGION 1..447: note = O24A_VH-CH/wt
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 556 - protein, 605 aa, synthetic construct
  REGION 1..605: note = RG1_VH-CH1/N84S/K147E/K213E/CLD201/hole/DHS/RF
QVQLVESGGGVVQPGRSLRLSCAASGFTFSNYAMYWVRQAPGKGLEWVAVISYDGSNKYYADSVKGRFTISRDNSKNTLYLQMSSLRTEDTAVYYCASGSDYGDYLLVYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 557 - protein, 438 aa, synthetic construct
  REGION 1..438: note = RG2_VK-x-CH1/knob/DHS
DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 558 - protein, 605 aa, synthetic construct
  REGION 1..605: note = RG1_VH-CH1/N84S/Q39K/S183E/CLD201/hole/DHS/RF
QVQLVESGGGVVQPGRSLRLSCAASGFTFSNYAMYWVRKAPGKGLEWVAVISYDGSNKYYADSVKGRFTISRDNSKNTLYLQMSSLRTEDTAVYYCASGSDYGDYLLVYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 559 - protein, 438 aa, synthetic construct
  REGION 1..438: note = RG2_VK-x-CH1/Q38E/S183K/knob/DHS
DIQMTQSPSSLSASVGDRVTITCQASQDITNYLNWYQEKPGKAPKLLIYAASNLETGVPSRFSGSGSGTDFTFTISGLQPEDIATYYCQQYDNLPLTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 560 - protein, 438 aa, synthetic construct
  REGION 1..438: note = RG2_VK-x-CH1/Q38K/S183K/knob/DHS
DIQMTQSPSSLSASVGDRVTITCQASQDITNYLNWYQKKPGKAPKLLIYAASNLETGVPSRFSGSGSGTDFTFTISGLQPEDIATYYCQQYDNLPLTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 561 - protein, 605 aa, synthetic construct
  REGION 1..605: note = RG2_VH-CH1/N84S/K147E/K213E/CLD201/hole/DHS/RF
QVQLVESGGGLVKPGGSLRLSCAASGFTFSDYYMSWIRQAPGKGLEWVSYITYSGSTIYYADSVKGRFTISRDNAKSSLYLQMSSLRAEDTAVYYCARDRGTTMVPFDYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 562 - protein, 441 aa, synthetic construct
  REGION 1..441: note = RG1_VL-x-CH1/knob/DHS
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 563 - protein, 605 aa, synthetic construct
  REGION 1..605: note = RG2_VH-CH1/N84S/Q39K/S183E/CLD201/hole/DHS/RF
QVQLVESGGGLVKPGGSLRLSCAASGFTFSDYYMSWIRKAPGKGLEWVSYITYSGSTIYYADSVKGRFTISRDNAKSSLYLQMSSLRAEDTAVYYCARDRGTTMVPFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 564 - protein, 441 aa, synthetic construct
  REGION 1..441: note = RG1_VL-x-CH1/Q38E/S183K/knob/DHS
QSALTQPASVSGSPGQSITISCTGTSSDVGGYNYVSWYQEHPGKAPKLMIYDVSKRPSGVSNRFSGSKSGNTASLTISGLQSEDEADYYCNSLTSISTWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 565 - protein, 441 aa, synthetic construct
  REGION 1..441: note = RG1_VL-x-CH1/Q38K/S183K/knob/DHS
QSALTQPASVSGSPGQSITISCTGTSSDVGGYNYVSWYQKHPGKAPKLMIYDVSKRPSGVSNRFSGSKSGNTASLTISGLQSEDEADYYCNSLTSISTWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 566 - protein, 605 aa, synthetic construct
  REGION 1..605: note = RG1_VH-CH1/N84S/K147E/K213E/CLD201/knob/DHS
QVQLVESGGGVVQPGRSLRLSCAASGFTFSNYAMYWVRQAPGKGLEWVAVISYDGSNKYYADSVKGRFTISRDNSKNTLYLQMSSLRTEDTAVYYCASGSDYGDYLLVYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 567 - protein, 438 aa, synthetic construct
  REGION 1..438: note = RG2_VK-x-CH1/hole/DHS/RF
DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 568 - protein, 605 aa, synthetic construct
  REGION 1..605: note = RG1_VH-CH1/N84S/Q39K/S183E/CLD201/knob/DHS
QVQLVESGGGVVQPGRSLRLSCAASGFTFSNYAMYWVRKAPGKGLEWVAVISYDGSNKYYADSVKGRFTISRDNSKNTLYLQMSSLRTEDTAVYYCASGSDYGDYLLVYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 569 - protein, 438 aa, synthetic construct
  REGION 1..438: note = RG2_VK-x-CH1/Q38E/S183K/hole/DHS/RF
DIQMTQSPSSLSASVGDRVTITCQASQDITNYLNWYQEKPGKAPKLLIYAASNLETGVPSRFSGSGSGTDFTFTISGLQPEDIATYYCQQYDNLPLTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 570 - protein, 438 aa, synthetic construct
  REGION 1..438: note = RG2_VK-x-CH1/Q38K/S183K/hole/DHS/RF
DIQMTQSPSSLSASVGDRVTITCQASQDITNYLNWYQKKPGKAPKLLIYAASNLETGVPSRFSGSGSGTDFTFTISGLQPEDIATYYCQQYDNLPLTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 571 - protein, 605 aa, synthetic construct
  REGION 1..605: note = RG2_VH-CH1/N84S/K147E/K213E/CLD201/knob/DHS
QVQLVESGGGLVKPGGSLRLSCAASGFTFSDYYMSWIRQAPGKGLEWVSYITYSGSTIYYADSVKGRFTISRDNAKSSLYLQMSSLRAEDTAVYYCARDRGTTMVPFDYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 572 - protein, 441 aa, synthetic construct
  REGION 1..441: note = RG1_VL-x-CH1/hole/DHS/RF
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 573 - protein, 605 aa, synthetic construct
  REGION 1..605: note = RG2_VH-CH1/N84S/Q39K/S183E/CLD201/knob/DHS
QVQLVESGGGLVKPGGSLRLSCAASGFTFSDYYMSWIRKAPGKGLEWVSYITYSGSTIYYADSVKGRFTISRDNAKSSLYLQMSSLRAEDTAVYYCARDRGTTMVPFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 574 - protein, 441 aa, synthetic construct
  REGION 1..441: note = RG1_VL-x-CH1/Q38E/S183K/hole/DHS/RF
QSALTQPASVSGSPGQSITISCTGTSSDVGGYNYVSWYQEHPGKAPKLMIYDVSKRPSGVSNRFSGSKSGNTASLTISGLQSEDEADYYCNSLTSISTWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 575 - protein, 441 aa, synthetic construct
  REGION 1..441: note = RG1_VL-x-CH1/Q38K/S183K/hole/DHS/RF
QSALTQPASVSGSPGQSITISCTGTSSDVGGYNYVSWYQKHPGKAPKLMIYDVSKRPSGVSNRFSGSKSGNTASLTISGLQSEDEADYYCNSLTSISTWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 576 - protein, 216 aa, synthetic construct
  REGION 1..216: note = RG1_VL-CL/E123R/Q124K
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLTVLGQPKAAPSVTLFPPSSRKLQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 577 - protein, 227 aa, synthetic construct
  REGION 1..227: note = RG2_VH-x-CK/N84S
QVQLVESGGGLVKPGGSLRLSCAASGFTFSDYYMSWIRQAPGKGLEWVSYITYSGSTIYYADSVKGRFTISRDNAKSSLYLQMSSLRAEDTAVYYCARDRGTTMVPFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 578 - protein, 216 aa, synthetic construct
  REGION 1..216: note = RG1_VL-CL/Q38E/V133K
QSALTQPASVSGSPGQSITISCTGTSSDVGGYNYVSWYQEHPGKAPKLMIYDVSKRPSGVSNRFSGSKSGNTASLTISGLQSEDEADYYCNSLTSISTWVFGGGTKLTVLGQPKAAPSVTLFPPSSEELQANKATLKCLISDFYPGAVTVAWKADSSPVKAGVETTTPSKQSNNKYAASSYLSLTPEQWKSHRSYSCQVTHEGSTVEKTVAPTECS

SEQ ID NO: 579 - protein, 227 aa, synthetic construct
  REGION 1..227: note = RG2_VH-x-CK/N84S/Q39K/V133E
QVQLVESGGGLVKPGGSLRLSCAASGFTFSDYYMSWIRKAPGKGLEWVSYITYSGSTIYYADSVKGRFTISRDNAKSSLYLQMSSLRAEDTAVYYCARDRGTTMVPFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 580 - protein, 227 aa, synthetic construct
  REGION 1..227: note = RG2_VH-x-CK/N84S/Q39E/V133E
QVQLVESGGGLVKPGGSLRLSCAASGFTFSDYYMSWIREAPGKGLEWVSYITYSGSTIYYADSVKGRFTISRDNAKSSLYLQMSSLRAEDTAVYYCARDRGTTMVPFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 581 - protein, 214 aa, synthetic construct
  REGION 1..214: note = RG2_VK-CK/E123R/Q124K
DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 582 - protein, 225 aa, synthetic construct
  REGION 1..225: note = RG1_VH-x-CL/N84S
QVQLVESGGGVVQPGRSLRLSCAASGFTFSNYAMYWVRQAPGKGLEWVAVISYDGSNKYYADSVKGRFTISRDNSKNTLYLQMSSLRTEDTAVYYCASGSDYGDYLLVYWGQGTLVTVSGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 583 - protein, 214 aa, synthetic construct
  REGION 1..214: note = RG2_VK-CK/Q38E/V133K
DIQMTQSPSSLSASVGDRVTITCQASQDITNYLNWYQEKPGKAPKLLIYAASNLETGVPSRFSGSGSGTDFTFTISGLQPEDIATYYCQQYDNLPLTFGGGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 584 - protein, 225 aa, synthetic construct
  REGION 1..225: note = RG1_VH-x-CL/N84S/Q39K/V133E
QVQLVESGGGVVQPGRSLRLSCAASGFTFSNYAMYWVRKAPGKGLEWVAVISYDGSNKYYADSVKGRFTISRDNSKNTLYLQMSSLRTEDTAVYYCASGSDYGDYLLVYWGQGTLVTVSGQPKAAPSVTLFPPSSEELQANKATLECLISDFYPGAVTVAWKADSSPVKAGVETTTPSKQSNNKYAASSYLSLTPEQWKSHRSYSCQVTHEGSTVEKTVAPTECS

SEQ ID NO: 585 - protein, 225 aa, synthetic construct
  REGION 1..225: note = RG1_VH-x-CL/N84S/Q39E/V133E
QVQLVESGGGVVQPGRSLRLSCAASGFTFSNYAMYWVREAPGKGLEWVAVISYDGSNKYYADSVKGRFTISRDNSKNTLYLQMSSLRTEDTAVYYCASGSDYGDYLLVYWGQGTLVTVSGQPKAAPSVTLFPPSSEELQANKATLECLISDFYPGAVTVAWKADSSPVKAGVETTTPSKQSNNKYAASSYLSLTPEQWKSHRSYSCQVTHEGSTVEKTVAPTECS

SEQ ID NO: 586 - protein, 217 aa, synthetic construct
  REGION 1..217: note = RG1_VL-CK/E123R/Q124K
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 587 - protein, 217 aa, synthetic construct
  REGION 1..217: note = RG1_VL-CK/Q38E/V133K
QSALTQPASVSGSPGQSITISCTGTSSDVGGYNYVSWYQEHPGKAPKLMIYDVSKRPSGVSNRFSGSKSGNTASLTISGLQSEDEADYYCNSLTSISTWVFGGGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 588 - protein, 227 aa, synthetic construct
  REGION 1..227: note = RG1_VH-x-CK/N84S
QVQLVESGGGVVQPGRSLRLSCAASGFTFSNYAMYWVRQAPGKGLEWVAVISYDGSNKYYADSVKGRFTISRDNSKNTLYLQMSSLRTEDTAVYYCASGSDYGDYLLVYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 589 - protein, 227 aa, synthetic construct
  REGION 1..227: note = RG1_VH-x-CK/N84S/Q39K/V133E
QVQLVESGGGVVQPGRSLRLSCAASGFTFSNYAMYWVRKAPGKGLEWVAVISYDGSNKYYADSVKGRFTISRDNSKNTLYLQMSSLRTEDTAVYYCASGSDYGDYLLVYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 590 - protein, 227 aa, synthetic construct
  REGION 1..227: note = RG1_VH-x-CK/N84S/Q39E/V133E
QVQLVESGGGVVQPGRSLRLSCAASGFTFSNYAMYWVREAPGKGLEWVAVISYDGSNKYYADSVKGRFTISRDNSKNTLYLQMSSLRTEDTAVYYCASGSDYGDYLLVYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 591 - protein, 606 aa, synthetic construct
  REGION 1..606: note = B13A_VH-CH1/K147E/K213E/CLD201/hole/RF
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 592 - protein, 442 aa, synthetic construct
  REGION 1..442: note = O24A_VK-x-CH1/knob
DIVLTQSPASLAVFLGQRATISCRASKSVSTSGYSYMHWYQQRPGQPPKLLIYLASNLESGVPARFSGSGSGTDFTLNIHPVEEEDAATYYCQHSRELPPTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 593 - protein, 606 aa, synthetic construct
  REGION 1..606: note = B13A_VH-CH1/N84S/Q39K/S183E/CLD201/hole/RF
QVQLQQSGAELVKPGASVKISCKASGYAFSNYWMNWVKKRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 594 - protein, 442 aa, synthetic construct
  REGION 1..442: note = O24A_VK-x-CH1/Q38E/S183K/knob
DIVLTQSPASLAVFLGQRATISCRASKSVSTSGYSYMHWYQERPGQPPKLLIYLASNLESGVPARFSGSGSGTDFTLNIHPVEEEDAATYYCQHSRELPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 595 - protein, 442 aa, synthetic construct
  REGION 1..442: note = O24A_VK-x-CH1/Q38K/S183K/knob
DIVLTQSPASLAVFLGQRATISCRASKSVSTSGYSYMHWYQKRPGQPPKLLIYLASNLESGVPARFSGSGSGTDFTLNIHPVEEEDAATYYCQHSRELPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 596 - protein, 606 aa, synthetic construct
  REGION 1..606: note = B13A_VH-CH1/K147E/K213E/CLD201/hole/DHS/RF
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 597 - protein, 442 aa, synthetic construct
  REGION 1..442: note = O24A_VK-x-CH1/knob/DHS
DIVLTQSPASLAVFLGQRATISCRASKSVSTSGYSYMHWYQQRPGQPPKLLIYLASNLESGVPARFSGSGSGTDFTLNIHPVEEEDAATYYCQHSRELPPTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 598 - protein, 606 aa, synthetic construct
  REGION 1..606: note = B13A_VH-CH1/N84S/Q39K/S183E/CLD201/hole/DHS/RF
QVQLQQSGAELVKPGASVKISCKASGYAFSNYWMNWVKKRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 599 - protein, 442 aa, synthetic construct
  REGION 1..442: note = O24A_VK-x-CH1/Q38E/S183K/knob/DHS
DIVLTQSPASLAVFLGQRATISCRASKSVSTSGYSYMHWYQERPGQPPKLLIYLASNLESGVPARFSGSGSGTDFTLNIHPVEEEDAATYYCQHSRELPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 600 - protein, 442 aa, synthetic construct
  REGION 1..442: note = O24A_VK-x-CH1/Q38K/S183K/knob/DHS
DIVLTQSPASLAVFLGQRATISCRASKSVSTSGYSYMHWYQKRPGQPPKLLIYLASNLESGVPARFSGSGSGTDFTLNIHPVEEEDAATYYCQHSRELPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 601 - protein, 603 aa, synthetic construct
  REGION 1..603: note = O24A_VH-CH1/K147E/K213E/CLD201/hole/RF
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 602 - protein, 438 aa, synthetic construct
  REGION 1..438: note = B13A_VK-x-CH1/knob
DIQMTQTTSSLSASLGDRVTISCRASQDISNYLNWYQQKPDGTVKLLIYYTSRLQSGVPSRFSGSGTGTDYSLTISNLEQEDIATYFCQQGNTLPWTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 603 - protein, 603 aa, synthetic construct
  REGION 1..603: note = O24A_VH-CH1/N84S/Q39K/S183E/CLD201/hole/RF
QAYLQQSGAELVRPGASVKMSCKASGYTFTSYSMHWVKKTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 604 - protein, 438 aa, synthetic construct
  REGION 1..438: note = B13A_VK-x-CH1/Q38E/S183K/knob
DIQMTQTTSSLSASLGDRVTISCRASQDISNYLNWYQEKPDGTVKLLIYYTSRLQSGVPSRFSGSGTGTDYSLTISNLEQEDIATYFCQQGNTLPWTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 605 - protein, 438 aa, synthetic construct
  REGION 1..438: note = B13A_VK-x-CH1/Q38K/S183K/knob
DIQMTQTTSSLSASLGDRVTISCRASQDISNYLNWYQKKPDGTVKLLIYYTSRLQSGVPSRFSGSGTGTDYSLTISNLEQEDIATYFCQQGNTLPWTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 606 - protein, 603 aa, synthetic construct
  REGION 1..603: note = O24A_VH-CH1/K147E/K213E/CLD201/hole/DHS/RF
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 607 - protein, 438 aa, synthetic construct
  REGION 1..438: note = B13A_VK-x-CH1/knob/DHS
DIQMTQTTSSLSASLGDRVTISCRASQDISNYLNWYQQKPDGTVKLLIYYTSRLQSGVPSRFSGSGTGTDYSLTISNLEQEDIATYFCQQGNTLPWTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 608 - protein, 603 aa, synthetic construct
  REGION 1..603: note = O24A_VH-CH1/N84S/Q39K/S183E/CLD201/hole/DHS/RF
QAYLQQSGAELVRPGASVKMSCKASGYTFTSYSMHWVKKTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 609 - protein, 438 aa, synthetic construct
  REGION 1..438: note = B13A_VK-x-CH1/Q38E/S183K/knob/DHS
DIQMTQTTSSLSASLGDRVTISCRASQDISNYLNWYQEKPDGTVKLLIYYTSRLQSGVPSRFSGSGTGTDYSLTISNLEQEDIATYFCQQGNTLPWTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 610 - protein, 438 aa, synthetic construct
  REGION 1..438: note = B13A_VK-x-CH1/Q38K/S183K/knob/DHS
DIQMTQTTSSLSASLGDRVTISCRASQDISNYLNWYQKKPDGTVKLLIYYTSRLQSGVPSRFSGSGTGTDYSLTISNLEQEDIATYFCQQGNTLPWTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 611 - protein, 606 aa, synthetic construct
  REGION 1..606: note = B13A_VH-CH1/K147E/K213E/CLD201/knob
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 612 - protein, 442 aa, synthetic construct
  REGION 1..442: note = O24A_VK-x-CH1/hole/RF
DIVLTQSPASLAVFLGQRATISCRASKSVSTSGYSYMHWYQQRPGQPPKLLIYLASNLESGVPARFSGSGSGTDFTLNIHPVEEEDAATYYCQHSRELPPTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 613 - protein, 606 aa, synthetic construct
  REGION 1..606: note = B13A_VH-CH1/N84S/Q39K/S183E/CLD201/knob
QVQLQQSGAELVKPGASVKISCKASGYAFSNYWMNWVKKRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 614 - protein, 442 aa, synthetic construct
  REGION 1..442: note = O24A_VK-x-CH1/Q38E/S183K/hole/RF
DIVLTQSPASLAVFLGQRATISCRASKSVSTSGYSYMHWYQERPGQPPKLLIYLASNLESGVPARFSGSGSGTDFTLNIHPVEEEDAATYYCQHSRELPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 615 - protein, 442 aa, synthetic construct
  REGION 1..442: note = O24A_VK-x-CH1/Q38K/S183K/hole/RF
DIVLTQSPASLAVFLGQRATISCRASKSVSTSGYSYMHWYQKRPGQPPKLLIYLASNLESGVPARFSGSGSGTDFTLNIHPVEEEDAATYYCQHSRELPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 616 - protein, 606 aa, synthetic construct
  REGION 1..606: note = B13A_VH-CH1/K147E/K213E/CLD201/knob/DHS
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 617 - protein, 442 aa, synthetic construct
  REGION 1..442: note = O24A_VK-x-CH1/hole/DHS/RF
DIVLTQSPASLAVFLGQRATISCRASKSVSTSGYSYMHWYQQRPGQPPKLLIYLASNLESGVPARFSGSGSGTDFTLNIHPVEEEDAATYYCQHSRELPPTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 618 - protein, 606 aa, synthetic construct
  REGION 1..606: note = B13A_VH-CH1/N84S/Q39K/S183E/CLD201/knob/DHS
QVQLQQSGAELVKPGASVKISCKASGYAFSNYWMNWVKKRPGKGLEWIGQIYPGDGDTNYNGNFKGKATLTADKSSSTAYIQLSSLTSEDSAVYFCGRGFIATVVEVFDHWGLGTTLTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 619 - protein, 442 aa, synthetic construct
  REGION 1..442: note = O24A_VK-x-CH1/Q38E/S183K/hole/DHS/RF
DIVLTQSPASLAVFLGQRATISCRASKSVSTSGYSYMHWYQERPGQPPKLLIYLASNLESGVPARFSGSGSGTDFTLNIHPVEEEDAATYYCQHSRELPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 620 - protein, 442 aa, synthetic construct
  REGION 1..442: note = O24A_VK-x-CH1/Q38K/S183K/hole/DHS/RF
DIVLTQSPASLAVFLGQRATISCRASKSVSTSGYSYMHWYQKRPGQPPKLLIYLASNLESGVPARFSGSGSGTDFTLNIHPVEEEDAATYYCQHSRELPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 621 - protein, 603 aa, synthetic construct
  REGION 1..603: note = O24A_VH-CH1/K147E/K213E/CLD201/knob
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 622 - protein, 438 aa, synthetic construct
  REGION 1..438: note = B13A_VK-x-CH1/hole/RF
DIQMTQTTSSLSASLGDRVTISCRASQDISNYLNWYQQKPDGTVKLLIYYTSRLQSGVPSRFSGSGTGTDYSLTISNLEQEDIATYFCQQGNTLPWTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 623 - protein, 603 aa, synthetic construct
  REGION 1..603: note = O24A_VH-CH1/N84S/Q39K/S183E/CLD201/knob
QAYLQQSGAELVRPGASVKMSCKASGYTFTSYSMHWVKKTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 624 - protein, 438 aa, synthetic construct
  REGION 1..438: note = B13A_VK-x-CH1/Q38E/S183K/hole/RF
DIQMTQTTSSLSASLGDRVTISCRASQDISNYLNWYQEKPDGTVKLLIYYTSRLQSGVPSRFSGSGTGTDYSLTISNLEQEDIATYFCQQGNTLPWTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 625 - protein, 438 aa, synthetic construct
  REGION 1..438: note = B13A_VK-x-CH1/Q38K/S183K/hole/RF
DIQMTQTTSSLSASLGDRVTISCRASQDISNYLNWYQKKPDGTVKLLIYYTSRLQSGVPSRFSGSGTGTDYSLTISNLEQEDIATYFCQQGNTLPWTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 626 - protein, 603 aa, synthetic construct
  REGION 1..603: note = O24A_VH-CH1/K147E/K213E/CLD201/knob/DHS
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 627 - protein, 438 aa, synthetic construct
  REGION 1..438: note = B13A_VK-x-CH1/hole/DHS/RF
DIQMTQTTSSLSASLGDRVTISCRASQDISNYLNWYQQKPDGTVKLLIYYTSRLQSGVPSRFSGSGTGTDYSLTISNLEQEDIATYFCQQGNTLPWTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 628 - protein, 603 aa, synthetic construct
  REGION 1..603: note = O24A_VH-CH1/N84S/Q39K/S183E/CLD201/knob/DHS
QAYLQQSGAELVRPGASVKMSCKASGYTFTSYSMHWVKKTPRQGLEWIGAIYPGNDDTSYNQKFKGKATLTVDRSSSTAYMQLSSLTSEDSAVYFCTRDYSNYPFDYWGQGTTLTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHSHYTQKSLSLSPG

SEQ ID NO: 629 - protein, 438 aa, synthetic construct
  REGION 1..438: note = B13A_VK-x-CH1/Q38E/S183K/hole/DHS/RF
DIQMTQTTSSLSASLGDRVTISCRASQDISNYLNWYQEKPDGTVKLLIYYTSRLQSGVPSRFSGSGTGTDYSLTISNLEQEDIATYFCQQGNTLPWTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 630 - protein, 438 aa, synthetic construct
  REGION 1..438: note = B13A_VK-x-CH1/Q38K/S183K/hole/DHS/RF
DIQMTQTTSSLSASLGDRVTISCRASQDISNYLNWYQKKPDGTVKLLIYYTSRLQSGVPSRFSGSGTGTDYSLTISNLEQEDIATYFCQQGNTLPWTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHSRFTQKSLSLSPG

SEQ ID NO: 631 - protein, 214 aa, synthetic construct
  REGION 1..214: note = B13A_VK-Ck/E123R/Q124K
DIQMTQTTSSLSASLGDRVTISCRASQDISNYLNWYQQKPDGTVKLLIYYTSRLQSGVPSRFSGSGTGTDYSLTISNLEQEDIATYFCQQGNTLPWTFGGGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 632 - protein, 225 aa, synthetic construct
  REGION 1..225: note = O24A_VH-x-CK
QAYLQQSGAELVRPGASVKMSCKASGYTFTSYSMHWVKQTPRQGLEWIGAIYPGNDDTSYNQKFKGKATLTVDRSSSTAYMQLSSLTSEDSAVYFCTRDYSNYPFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 633 - protein, 214 aa, synthetic construct
  REGION 1..214: note = B13A_VK-CK/Q38E/V133K
DIQMTQTTSSLSASLGDRVTISCRASQDISNYLNWYQEKPDGTVKLLIYYTSRLQSGVPSRFSGSGTGTDYSLTISNLEQEDIATYFCQQGNTLPWTFGGGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 634 - protein, 225 aa, synthetic construct
  REGION 1..225: note = O24A_VH-x-CK/Q39K/V133E
QAYLQQSGAELVRPGASVKMSCKASGYTFTSYSMHWVKKTPRQGLEWIGAIYPGNDDTSYNQKFKGKATLTVDRSSSTAYMQLSSLTSEDSAVYFCTRDYSNYPFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 635 - protein, 225 aa, synthetic construct
  REGION 1..225: note = O24A_VH-x-CK/Q39E/V133E
QAYLQQSGAELVRPGASVKMSCKASGYTFTSYSMHWVKETPRQGLEWIGAIYPGNDDTSYNQKFKGKATLTVDRSSSTAYMQLSSLTSEDSAVYFCTRDYSNYPFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 636 - protein, 218 aa, synthetic construct
  REGION 1..218: note = O24A_VK-Ck/E123R/Q124K
DIVLTQSPASLAVFLGQRATISCRASKSVSTSGYSYMHWYQQRPGQPPKLLIYLASNLESGVPARFSGSGSGTDFTLNIHPVEEEDAATYYCQHSRELPPTFGGGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 637 - protein, 228 aa, synthetic construct
  REGION 1..228: note = B13A_VH-x-CK
QVQLQQSGAELVKPGASVKISCKASGYAFSNYWMNWVKQRPGKGLEWIGQIYPGDGDTNYNGNFKGKATLTADKSSSTAYIQLSSLTSEDSAVYFCGRGFIATVVEVFDHWGLGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 638 - protein, 218 aa, synthetic construct
  REGION 1..218: note = O24A_VK-CK/Q38E/V133K
DIVLTQSPASLAVFLGQRATISCRASKSVSTSGYSYMHWYQERPGQPPKLLIYLASNLESGVPARFSGSGSGTDFTLNIHPVEEEDAATYYCQHSRELPPTFGGGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 639 - protein, 228 aa, synthetic construct
  REGION 1..228: note = B13A_VH-x-CK/Q39K/V133E
QVQLQQSGAELVKPGASVKISCKASGYAFSNYWMNWVKKRPGKGLEWIGQIYPGDGDTNYNGNFKGKATLTADKSSSTAYIQLSSLTSEDSAVYFCGRGFIATVVEVFDHWGLGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 640 - protein, 228 aa, synthetic construct
  REGION 1..228: note = B13A_VH-x-CK/Q39E/V133E
QVQLQQSGAELVKPGASVKISCKASGYAFSNYWMNWVKERPGKGLEWIGQIYPGDGDTNYNGNFKGKATLTADKSSSTAYIQLSSLTSEDSAVYFCGRGFIATVVEVFDHWGLGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 641 - protein, 451 aa, synthetic construct
  REGION 1..451: note = Da_VH-CH1
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 642 - protein, 451 aa, synthetic construct
  REGION 1..451: note = Da_VH-CH1/PGLALA
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 643 - protein, 607 aa, synthetic construct
  REGION 1..607: note = Da_VH-CH1/N84S/CLD201/hole/RF
EVQLLESGGGLVQPGGSLRLSCAVSGFTFNSFAMSWVRQAPGKGLEWVSAISGSGGGTYYADSVKGRFTISRDNSKNTLYLQMSSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 644 - protein, 451 aa, synthetic construct
  REGION 1..451: note = Da_VH-CH1/N84S/knob
EVQLLESGGGLVQPGGSLRLSCAVSGFTFNSFAMSWVRQAPGKGLEWVSAISGSGGGTYYADSVKGRFTISRDNSKNTLYLQMSSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 645 - protein, 607 aa, synthetic construct
  REGION 1..607: note = Da_VH-CH1/N84S/CLD201/hole/PGLALA/RF
EVQLLESGGGLVQPGGSLRLSCAVSGFTFNSFAMSWVRQAPGKGLEWVSAISGSGGGTYYADSVKGRFTISRDNSKNTLYLQMSSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 646 - protein, 451 aa, synthetic construct
  REGION 1..451: note = Da_VH-CH1/N84S/knob/PGLALA
EVQLLESGGGLVQPGGSLRLSCAVSGFTFNSFAMSWVRQAPGKGLEWVSAISGSGGGTYYADSVKGRFTISRDNSKNTLYLQMSSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 647 - protein, 607 aa, synthetic construct
  REGION 1..607: note = Da_VH-CH1/N84S/K147E/K213E/CLD201/hole/PGLALA/RF
EVQLLESGGGLVQPGGSLRLSCAVSGFTFNSFAMSWVRQAPGKGLEWVSAISGSGGGTYYADSVKGRFTISRDNSKNTLYLQMSSLRAEDTAVYFCAKDKILWFGEPVFDYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 648 - protein, 441 aa, synthetic construct
  REGION 1..441: note = HA9_VK-x-CH1/knob/PGLALA
DIELTQSPSSLSASVGDRVTITCRSNTGTVTTSNYASWYQQKPGKAPKGLIGHTNNRAPGVPSRFSGSLSGADATLTISSLQPEDLATYYCALWYNNHWVFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 649 - protein, 607 aa, synthetic construct
  REGION 1..607: note = Da_VH-CH1/N84S/Q39K/S183E/CLD201/hole/PGLALA/RF
EVQLLESGGGLVQPGGSLRLSCAVSGFTFNSFAMSWVRKAPGKGLEWVSAISGSGGGTYYADSVKGRFTISRDNSKNTLYLQMSSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 650 - protein, 441 aa, synthetic construct
  REGION 1..441: note = HA9_VK-x-CH1/Q38E/S183K/knob/PGLALA
DIELTQSPSSLSASVGDRVTITCRSNTGTVTTSNYASWYQEKPGKAPKGLIGHTNNRAPGVPSRFSGSLSGADATLTISSLQPEDLATYYCALWYNNHWVFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 651 - protein, 441 aa, synthetic construct
  REGION 1..441: note = HA9_VK-x-CH1/Q38K/S183K/knob/PGLALA
DIELTQSPSSLSASVGDRVTITCRSNTGTVTTSNYASWYQKKPGKAPKGLIGHTNNRAPGVPSRFSGSLSGADATLTISSLQPEDLATYYCALWYNNHWVFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 652 - protein, 602 aa, synthetic construct
  REGION 1..602: note = HA9_VH-CH1/N84S/K147E/K213E/CLD201/hole/PGLALA/RF
EVQLQESGGGLVQPGDSLRLSCAASGFTFSNYWLGWIRQAPGKGPEWVGDIYPGGGYTNYNEKFKGRFTISADTSKNIAYLQVSSLRAEDTAVYYCARSASWYFDVWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 653 - protein, 438 aa, synthetic construct
  REGION 1..438: note = Da_VK-x-CH1/knob/PGLALA
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 654 - protein, 602 aa, synthetic construct
  REGION 1..602: note = HA9_VH-CH1/N84S/Q39K/S183E/CLD201/hole/PGLALA/RF
EVQLQESGGGLVQPGDSLRLSCAASGFTFSNYWLGWIRKAPGKGPEWVGDIYPGGGYTNYNEKFKGRFTISADTSKNIAYLQVSSLRAEDTAVYYCARSASWYFDVWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 655 - protein, 438 aa, synthetic construct
  REGION 1..438: note = Da_VK-x-CH1/Q38E/S183K/knob/PGLALA
EIVLTQSPATLSLSPGERATLSCRASQSVSSYLAWYQEKPGQAPRLLIYDASNRATGIPARFSGSGSGTDFTLTISSLEPEDFAVYYCQQRSNWPPTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 656 - protein, 438 aa, synthetic construct
  REGION 1..438: note = Da_VK-x-CH1/Q38K/S183K/knob/PGLALA
EIVLTQSPATLSLSPGERATLSCRASQSVSSYLAWYQKKPGQAPRLLIYDASNRATGIPARFSGSGSGTDFTLTISSLEPEDFAVYYCQQRSNWPPTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 657 - protein, 440 aa, synthetic construct
  REGION 1..440: note = Sp34_VK-CH1/knob/PGLALA
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 658 - protein, 440 aa, synthetic construct
  REGION 1..440: note = Sp34_VK-CH1/knob/Q38E/S183K/PGLALA
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 659 - protein, 440 aa, synthetic construct
  REGION 1..440: note = Sp34_VK-CH1/knob/Q38K/S183K/PGLALA
QAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 660 - protein, 440 aa, synthetic construct
  REGION 1..440: note = Sp34_VK-CH1/knob/PGLALA/RF
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNRFTQKSLSLSPG

SEQ ID NO: 661 - protein, 440 aa, synthetic construct
  REGION 1..440: note = Sp34_VK-CH1/knob/Q38E/S183K/PGLALA/RF
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNRFTQKSLSLSPG

SEQ ID NO: 662 - protein, 440 aa, synthetic construct
  REGION 1..440: note = Sp34_VK-CH1/knob/Q38K/S183K/PGLALA/RF
QAVVTQEPSLTVSPGGTVTLTCGSSTGAVTTSNYANWVQKKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNRFTQKSLSLSPG

SEQ ID NO: 663 - protein, 447 aa, synthetic construct
  REGION 1..447: note = 4C8_VH-CH1
QVQLVQSGAEVKKPGSSVKVSCKASGYTFTSYVMHWVRQAPGQGLEWMGYIIPYNDATKYNEKFKGRVTITADKSTSTAYMELSSLRSEDTAVYYCARYNYDGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 664 - protein, 447 aa, synthetic construct
  REGION 1..447: note = 4C8_VH-CH1/SIDE
QVQLVQSGAEVKKPGSSVKVSCKASGYTFTSYVMHWVRQAPGQGLEWMGYIIPYNDATKYNEKFKGRVTITADKSTSTAYMELSSLRSEDTAVYYCARYNYDGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 665 - protein, 603 aa, synthetic construct
  REGION 1..603: note = 4C8_VH-CH1/CLD201/hole/RF
QVQLVQSGAEVKKPGSSVKVSCKASGYTFTSYVMHWVRQAPGQGLEWMGYIIPYNDATKYNEKFKGRVTITADKSTSTAYMELSSLRSEDTAVYYCARYNYDGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 666 - protein, 447 aa, synthetic construct
  REGION 1..447: note = 4C8_VH-CH1/knob
QVQLVQSGAEVKKPGSSVKVSCKASGYTFTSYVMHWVRQAPGQGLEWMGYIIPYNDATKYNEKFKGRVTITADKSTSTAYMELSSLRSEDTAVYYCARYNYDGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 667 - protein, 603 aa, synthetic construct
  REGION 1..603: note = 4C8_VH-CH1/CLD201/hole/SIDE/RF
QVQLVQSGAEVKKPGSSVKVSCKASGYTFTSYVMHWVRQAPGQGLEWMGYIIPYNDATKYNEKFKGRVTITADKSTSTAYMELSSLRSEDTAVYYCARYNYDGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 668 - protein, 447 aa, synthetic construct
  REGION 1..447: note = 4C8_VH-CH1/knob/SIDE
QVQLVQSGAEVKKPGSSVKVSCKASGYTFTSYVMHWVRQAPGQGLEWMGYIIPYNDATKYNEKFKGRVTITADKSTSTAYMELSSLRSEDTAVYYCARYNYDGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 669 - protein, 603 aa, synthetic construct
  REGION 1..603: note = 4C8_VH-CH1/K147E/K213E/CLD201/hole/PGLALA/RF
QVQLVQSGAEVKKPGSSVKVSCKASGYTFTSYVMHWVRQAPGQGLEWMGYIIPYNDATKYNEKFKGRVTITADKSTSTAYMELSSLRSEDTAVYYCARYNYDGYFDVWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 670 - protein, 603 aa, synthetic construct
  REGION 1..603: note = 4C8_VH-CH1/Q39K/S183E/CLD201/hole/PGLALA/RF
QVQLVQSGAEVKKPGSSVKVSCKASGYTFTSYVMHWVRKAPGQGLEWMGYIIPYNDATKYNEKFKGRVTITADKSTSTAYMELSSLRSEDTAVYYCARYNYDGYFDVWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 671 - protein, 603 aa, synthetic construct
  REGION 1..603: note = 4C8_VH-CH1/K147E/K213E/CLD201/hole/RF
QVQLVQSGAEVKKPGSSVKVSCKASGYTFTSYVMHWVRQAPGQGLEWMGYIIPYNDATKYNEKFKGRVTITADKSTSTAYMELSSLRSEDTAVYYCARYNYDGYFDVWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 672 - protein, 438 aa, synthetic construct
  REGION 1..438: note = Da_VK-x-CH1/knob
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 673 - protein, 603 aa, synthetic construct
  REGION 1..603: note = 4C8_VH-CH1/Q39K/S183E/CLD201/hole/RF
QVQLVQSGAEVKKPGSSVKVSCKASGYTFTSYVMHWVRKAPGQGLEWMGYIIPYNDATKYNEKFKGRVTITADKSTSTAYMELSSLRSEDTAVYYCARYNYDGYFDVWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 674 - protein, 438 aa, synthetic construct
  REGION 1..438: note = Da_VK-x-CH1/Q38E/S183K/knob
EIVLTQSPATLSLSPGERATLSCRASQSVSSYLAWYQEKPGQAPRLLIYDASNRATGIPARFSGSGSGTDFTLTISSLEPEDFAVYYCQQRSNWPPTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 675 - protein, 438 aa, synthetic construct
  REGION 1..438: note = Da_VK-x-CH1/Q38K/S183K/knob
EIVLTQSPATLSLSPGERATLSCRASQSVSSYLAWYQKKPGQAPRLLIYDASNRATGIPARFSGSGSGTDFTLTISSLEPEDFAVYYCQQRSNWPPTFGQGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 676 - protein, 450 aa, synthetic construct
  REGION 1..450: note = B34_VH-CH1
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 677 - protein, 450 aa, synthetic construct
  REGION 1..450: note = B34_VH-CH1/SIDE
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 678 - protein, 606 aa, synthetic construct
  REGION 1..606: note = B34_VH-CH1/CLD201/hole/RF
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 679 - protein, 450 aa, synthetic construct
  REGION 1..450: note = B34_VH-CH1/knob
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 680 - protein, 606 aa, synthetic construct
  REGION 1..606: note = B34_VH-CH1/CLD201/hole/SIDE/RF
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 681 - protein, 450 aa, synthetic construct
  REGION 1..450: note = B34_VH-CH1/knob/SIDE
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 682 - protein, 606 aa, synthetic construct
  REGION 1..606: note = B34_VH-CH1/K147E/K213E/CLD201/hole/PGLALA/RF
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 683 - protein, 606 aa, synthetic construct
  REGION 1..606: note = B34_VH-CH1/Q39K/S183E/CLD201/hole/PGLALA/RF
QVQLVQSGAEVKKPGASVKVSCKASGYTFTNHIIHWVRKAPGQGLEWMGYINPYPGYHAYNEKFQGRATMTSDTSTSTVYMELSSLRSEDTAVYYCARDGYYRDTDVLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 684 - protein, 606 aa, synthetic construct
  REGION 1..606: note = B34_VH-CH1/K147E/K213E/CLD201/hole/RF
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 685 - protein, 606 aa, synthetic construct
  REGION 1..606: note = B34_VH-CH1/Q39K/S183E/CLD201/hole/RF
QVQLVQSGAEVKKPGASVKVSCKASGYTFTNHIIHWVRKAPGQGLEWMGYINPYPGYHAYNEKFQGRATMTSDTSTSTVYMELSSLRSEDTAVYYCARDGYYRDTDVLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 686 - protein, 214 aa, synthetic construct
  REGION 1..214: note = Da_VK-CK
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 687 - protein, 214 aa, synthetic construct
  REGION 1..214: note = Da_VK-Ck/E123R/Q124K
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 688 - protein, 224 aa, synthetic construct
  REGION 1..224: note = HA9_VH-x-CK/N84S
EVQLQESGGGLVQPGDSLRLSCAASGFTFSNYWLGWIRQAPGKGPEWVGDIYPGGGYTNYNEKFKGRFTISADTSKNIAYLQVSSLRAEDTAVYYCARSASWYFDVWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 689 - protein, 214 aa, synthetic construct
  REGION 1..214: note = Da_VK-CK/Q38E/V133K
EIVLTQSPATLSLSPGERATLSCRASQSVSSYLAWYQEKPGQAPRLLIYDASNRATGIPARFSGSGSGTDFTLTISSLEPEDFAVYYCQQRSNWPPTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 690 - protein, 224 aa, synthetic construct
  REGION 1..224: note = HA9_VH-x-CK/N84S/Q39K/V133E
EVQLQESGGGLVQPGDSLRLSCAASGFTFSNYWLGWIRKAPGKGPEWVGDIYPGGGYTNYNEKFKGRFTISADTSKNIAYLQVSSLRAEDTAVYYCARSASWYFDVWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 691 - protein, 224 aa, synthetic construct
  REGION 1..224: note = HA9_VH-x-CK/N84S/Q39E/V133E
EVQLQESGGGLVQPGDSLRLSCAASGFTFSNYWLGWIREAPGKGPEWVGDIYPGGGYTNYNEKFKGRFTISADTSKNIAYLQVSSLRAEDTAVYYCARSASWYFDVWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 692 - protein, 217 aa, synthetic construct
  REGION 1..217: note = HA9_VK-Ck/E123R/Q124K
DIELTQSPSSLSASVGDRVTITCRSNTGTVTTSNYASWYQQKPGKAPKGLIGHTNNRAPGVPSRFSGSLSGADATLTISSLQPEDLATYYCALWYNNHWVFGQGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 693 - protein, 229 aa, synthetic construct
  REGION 1..229: note = Da_VH-x-CK/N84S
EVQLLESGGGLVQPGGSLRLSCAVSGFTFNSFAMSWVRQAPGKGLEWVSAISGSGGGTYYADSVKGRFTISRDNSKNTLYLQMSSLRAEDTAVYFCAKDKILWFGEPVFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 694 - protein, 217 aa, synthetic construct
  REGION 1..217: note = HA9_VK-CK/Q38E/V133K
DIELTQSPSSLSASVGDRVTITCRSNTGTVTTSNYASWYQEKPGKAPKGLIGHTNNRAPGVPSRFSGSLSGADATLTISSLQPEDLATYYCALWYNNHWVFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 695 - protein, 229 aa, synthetic construct
  REGION 1..229: note = Da_VH-x-CK/N84S/Q39K/V133E
EVQLLESGGGLVQPGGSLRLSCAVSGFTFNSFAMSWVRKAPGKGLEWVSAISGSGGGTYYADSVKGRFTISRDNSKNTLYLQMSSLRAEDTAVYFCAKDKILWFGEPVFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 696 - protein, 229 aa, synthetic construct
  REGION 1..229: note = Da_VH-x-CK/N84S/Q39E/V133E
EVQLLESGGGLVQPGGSLRLSCAVSGFTFNSFAMSWVREAPGKGLEWVSAISGSGGGTYYADSVKGRFTISRDNSKNTLYLQMSSLRAEDTAVYFCAKDKILWFGEPVFDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 697 - protein, 232 aa, synthetic construct
  REGION 1..232: note = Sp34_VH-cK/N84S
EVQLLESGGGLVQPGGSLRLSCAASGFTFSTYAMNWVRQAPGKGLEWVSRIRSKYNNYATYYADSVKGRFTISRDDSKNTLYLQMSSLRAEDTAVYYCVRHGNFGNSYVSWFAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 698 - protein, 232 aa, synthetic construct
  REGION 1..232: note = Sp34_VH-CK/N84S/Q39K/V133E
EVQLLESGGGLVQPGGSLRLSCAASGFTFSTYAMNWVRKAPGKGLEWVSRIRSKYNNYATYYADSVKGRFTISRDDSKNTLYLQMSSLRAEDTAVYYCVRHGNFGNSYVSWFAYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 699 - protein, 232 aa, synthetic construct
  REGION 1..232: note = Sp34_VH-CK/N84S/Q39E/V133E
EVQLLESGGGLVQPGGSLRLSCAASGFTFSTYAMNWVREAPGKGLEWVSRIRSKYNNYATYYADSVKGRFTISRDDSKNTLYLQMSSLRAEDTAVYYCVRHGNFGNSYVSWFAYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 700 - protein, 214 aa, synthetic construct
  REGION 1..214: note = 4C8_VK-CK
EIVLTQSPATLSLSPGERATLSCRASQSISDYLHWYQQKPGQAPRLLIYYASQSITGIPARFSGSGSGTDFTLTISSLEPEDFAVYYCQNGHSFPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 701 - protein, 214 aa, synthetic construct
  REGION 1..214: note = 4C8_VK-Ck/E123R/Q124K
EIVLTQSPATLSLSPGERATLSCRASQSISDYLHWYQQKPGQAPRLLIYYASQSITGIPARFSGSGSGTDFTLTISSLEPEDFAVYYCQNGHSFPPTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 702 - protein, 214 aa, synthetic construct
  REGION 1..214: note = 4C8_VK-CK/Q38E/V133K
EIVLTQSPATLSLSPGERATLSCRASQSISDYLHWYQEKPGQAPRLLIYYASQSITGIPARFSGSGSGTDFTLTISSLEPEDFAVYYCQNGHSFPPTFGGGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 703 - protein, 214 aa, synthetic construct
  REGION 1..214: note = B34_VK-CK
DIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 704 - protein, 214 aa, synthetic construct
  REGION 1..214: note = B34_VK-Ck/E123R/Q124K
DIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGQGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 705 - protein, 214 aa, synthetic construct
  REGION 1..214: note = B34_VK-CK/Q38E/V133K
DIQMTQSPSSLSASVGDRVTITCQASQDISNYLNWYQEKPGKAPKLLIYYTSRLHTGVPSRFSGSGSGTDFTFTISSLEPEDIATYYCQQGNTLPWTFGQGTKVEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 706 - protein, 221 aa, synthetic construct
  REGION 1..221: note = Fc6/knob/PGLALA
CPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 707 - protein, 606 aa, synthetic construct
  REGION 1..606: note = R_VH-CH1/K147E/K213E/CLD201/hole/RF
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 708 - protein, 438 aa, synthetic construct
  REGION 1..438: note = FMC63_VK-x-CH1/knob
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 709 - protein, 606 aa, synthetic construct
  REGION 1..606: note = R_VH-CH1/Q39K/S183E/CLD201/hole/RF
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 710 - protein, 438 aa, synthetic construct
  REGION 1..438: note = FMC63_VK-x-CH1/Q38E/S183K/knob
DIQMTQTTSSLSASLGDRVTISCRASQDISKYLNWYQEKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 711 - protein, 438 aa, synthetic construct
  REGION 1..438: note = FMC63_VK-x-CH1/Q38K/S183K/knob
DIQMTQTTSSLSASLGDRVTISCRASQDISKYLNWYQKKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 712 - protein, 605 aa, synthetic construct
  REGION 1..605: note = FMC63_VH-CH1/N84S/K147E/K213E/CLD201/hole/RF
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 713 - protein, 437 aa, synthetic construct
  REGION 1..437: note = R_VK-x-CH1/knob
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 714 - protein, 605 aa, synthetic construct
  REGION 1..605: note = FMC63_VH-CH1/N84S/Q39K/S183E/CLD201/hole/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 715 - protein, 437 aa, synthetic construct
  REGION 1..437: note = R_VK-x-CH1/Q38E/S183K/knob
QIVLSQSPAILSASPGEKVTMTCRASSSVSYIHWFQEKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 716 - protein, 437 aa, synthetic construct
  REGION 1..437: note = R_VK-x-CH1/Q38K/S183K/knob
QIVLSQSPAILSASPGEKVTMTCRASSSVSYIHWFQKKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 717 - protein, 1019 aa, synthetic construct
  REGION 1..1019: note = FMC63_VK-x-CH1/knob/41BBL
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 718 - protein, 1019 aa, synthetic construct
  REGION 1..1019: note = FMC63_VK-x-CH1/Q38E/S183K/knob/41BBL
DIQMTQTTSSLSASLGDRVTISCRASQDISKYLNWYQEKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 719 - protein, 1019 aa, synthetic construct
  REGION 1..1019: note = FMC63_VK-x-CH1/Q38K/S183K/knob/41BBL
DIQMTQTTSSLSASLGDRVTISCRASQDISKYLNWYQKKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 720 - protein, 1018 aa, synthetic construct
  REGION 1..1018: note = R_VK-x-CH1/knob/41BBL
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 721 - protein, 1018 aa, synthetic construct
  REGION 1..1018: note = R_VK-x-CH1/Q38E/S183K/knob/41BBL
QIVLSQSPAILSASPGEKVTMTCRASSSVSYIHWFQEKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 722 - protein, 1018 aa, synthetic construct
  REGION 1..1018: note = R_VK-x-CH1/Q38K/S183K/knob/41BBL
QIVLSQSPAILSASPGEKVTMTCRASSSVSYIHWFQKKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 723 - protein, 606 aa, synthetic construct
  REGION 1..606: note = R_VH-CH1/K147E/K213E/CLD201/hole/PGLALA/RF
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 724 - protein, 1019 aa, synthetic construct
  REGION 1..1019: note = FMC63_VK-x-CH1/knob/PGLALA/41BBL
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 725 - protein, 606 aa, synthetic construct
  REGION 1..606: note = R_VH-CH1/Q39K/S183E/CLD201/hole/PGLALA/RF
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 726 - protein, 1019 aa, synthetic construct
  REGION 1..1019: note = FMC63_VK-x-CH1/Q38E/S183K/knob/PGLALA/41BBL
DIQMTQTTSSLSASLGDRVTISCRASQDISKYLNWYQEKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 727 - protein, 1019 aa, synthetic construct
  REGION 1..1019: note = FMC63_VK-x-CH1/Q38K/S183K/knob/PGLALA/41BBL
DIQMTQTTSSLSASLGDRVTISCRASQDISKYLNWYQKKPDGTVKLLIYHTSRLHSGVPSRFSGSGSGTDYSLTISNLEQEDIATYFCQQGNTLPYTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 728 - protein, 605 aa, synthetic construct
  REGION 1..605: note = FMC63_VH-CH1/N84S/K147E/K213E/CLD201/hole/PGLALA/RF
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 729 - protein, 1018 aa, synthetic construct
  REGION 1..1018: note = R_VK-x-CH1/knob/PGLALA/41BBL
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 730 - protein, 605 aa, synthetic construct
  REGION 1..605: note = FMC63_VH-CH1/N84S/Q39K/S183E/CLD201/hole/PGLALA/RF
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTSTSPTRSMAPGAVHLPQPVSTRDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPG

SEQ ID NO: 731 - protein, 1018 aa, synthetic construct
  REGION 1..1018: note = R_VK-x-CH1/Q38E/S183K/knob/PGLALA/41BBL
QIVLSQSPAILSASPGEKVTMTCRASSSVSYIHWFQEKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 732 - protein, 1018 aa, synthetic construct
  REGION 1..1018: note = R_VK-x-CH1/Q38K/S183K/knob/PGLALA/41BBL
QIVLSQSPAILSASPGEKVTMTCRASSSVSYIHWFQKKPGSSPKPWIYATSNLASGVPVRFSGSGSGTSYSLTISRVEAEDAATYYCQQWTSNPPTFGGGTKVEIKSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 733 - protein, 213 aa, synthetic construct
  REGION 1..213: note = R_VK-Ck/E123R/Q124K
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 734 - protein, 227 aa, synthetic construct
  REGION 1..227: note = FMC63_VH-x-CK/N84S
EVKLQESGPGLVAPSQSLSVTCTVSGVSLPDYGVSWIRQPPRKGLEWLGVIWGSETTYYNSALKSRLTIIKDNSKSQVFLKMSSLQTDDTAIYYCAKHYYYGGSYAMDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 735 - protein, 213 aa, synthetic construct
  REGION 1..213: note = R_VK-CK/Q38E/V133K
QIVLSQSPAILSASPGEKVTMTCRASSSVSYIHWFQEKPGSSPKPWIYATSNLASGVPVRFSGSGSGTSYSLTISRVEAEDAATYYCQQWTSNPPTFGGGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 736 - protein, 227 aa, synthetic construct
  REGION 1..227: note = FMC63_VH-x-CK/N84S/Q39K/V133E
EVKLQESGPGLVAPSQSLSVTCTVSGVSLPDYGVSWIRKPPRKGLEWLGVIWGSETTYYNSALKSRLTIIKDNSKSQVFLKMSSLQTDDTAIYYCAKHYYYGGSYAMDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 737 - protein, 227 aa, synthetic construct
  REGION 1..227: note = FMC63_VH-x-CK/N84S/Q39E/V133E
EVKLQESGPGLVAPSQSLSVTCTVSGVSLPDYGVSWIREPPRKGLEWLGVIWGSETTYYNSALKSRLTIIKDNSKSQVFLKMSSLQTDDTAIYYCAKHYYYGGSYAMDYWGQGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 738 - protein, 214 aa, synthetic construct
  REGION 1..214: note = FMC63_VK-Ck/E123R/Q124K
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 739 - protein, 228 aa, synthetic construct
  REGION 1..228: note = R_VH-x-CK
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 740 - protein, 214 aa, synthetic construct
  REGION 1..214: note = FMC63_VK-CK/Q38E/V133K
DIQMTQTTSSLSASLGDRVTISCRASQDISKYLNWYQEKPDGTVKLLIYHTSRLHSGVPSRFSGSGSGTDYSLTISNLEQEDIATYFCQQGNTLPYTFGGGTKLEIKRTVAAPSVFIFPPSDEQLKSGTASVKCLLNNFYPREAKVQWKVDNALQSGNSQESVTEQDSKDSTYSLSSTLTLSKADYEKHKVYACEVTHQGLSSPVTKSFNRGEC

SEQ ID NO: 741 - protein, 228 aa, synthetic construct
  REGION 1..228: note = R_VH-x-CK/Q39K/V133E
QVQLQQPGAELVKPGASVKMSCKASGYTFTSYNMHWVKKTPGRGLEWIGAIYPGNGDTSYNQKFKGKATLTADKSSSTAYMQLSSLTSEDSAVYYCARSTYYGGDWYFNVWGAGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 742 - protein, 228 aa, synthetic construct
  REGION 1..228: note = R_VH-x-CK/Q39E/V133E
QVQLQQPGAELVKPGASVKMSCKASGYTFTSYNMHWVKETPGRGLEWIGAIYPGNGDTSYNQKFKGKATLTADKSSSTAYMQLSSLTSEDSAVYYCARSTYYGGDWYFNVWGAGTLVTVSSASVAAPSVFIFPPSDEQLKSGTASVECLLNNFYPREAKVQWKVDNALQSGNSQESVTEQDSKDSTYSLSSTLTLSKADYEKHKVYACEVTHQGLSSPVTKSFNRGEC

SEQ ID NO: 743 - protein, 216 aa, synthetic construct
  REGION 1..216: note = EM901-L1_BCMA/VK-CK
EIVLTQSPGTLSLSPGERATLSCRASQSVSDEYLSWYQQKPGQAPRLLIHSASTRATGIPDRFSGSGSGTDFTLAISRLEPEDFAVYYCQQYGYPPDFTFGQGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 744 - protein, 232 aa, synthetic construct; identical to SEQ ID NO: 39
  REGION 1..232: note = EM901-L2_CD3/VH-CL

SEQ ID NO: 745 - protein, 670 aa, synthetic construct
  REGION 1..670: note = EM901-H1_BCMA/VH-CH1_CD3/VL-CH1
EVQLLESGGGLVQPGGSLRLSCAASGFTFSDNAMGWVRQAPGKGLEWVSAISGPGSSTYYADSVKGRFTISRDNSKNTLYLQMNSLRAEDTAVYYCAKVLGWFDYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSQAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 746 - protein, 445 aa, synthetic construct
  REGION 1..445: note = EM901-H2_BCMA/VH-CH1
EVQLLESGGGLVQPGGSLRLSCAASGFTFSDNAMGWVRQAPGKGLEWVSAISGPGSSTYYADSVKGRFTISRDNSKNTLYLQMNSLRAEDTAVYYCAKVLGWFDYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 747 - protein, 221 aa, synthetic construct; identical to SEQ ID NO: 73
  REGION 1..221: note = Fc6/hole/PGLALA/RF

SEQ ID NO: 748 - protein, 216 aa, synthetic construct
  REGION 1..216: note = 42-L_BCMA/VK-CK
EIVLTQSPGTLSLSPGERATLSCRASQSVSDEYLSWYQQKPGQAPRLLIHSASTRATGIPDRFSGSGSGTDFTLAISRLEPEDFAVYYCQQYGYPPDFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 749 - protein, 445 aa, synthetic construct
  REGION 1..445: note = 42-H_BCMA/VH-CH1/knob/PGLALA
EVQLLESGGGLVQPGGSLRLSCAASGFTFSDNAMGWVRQAPGKGLEWVSAISGPGSSTYYADSVKGRFTISRDNSKNTLYLQMNSLRAEDTAVYYCAKVLGWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 750 - protein, 219 aa, synthetic construct; identical to SEQ ID NO: 38
  REGION 1..219: note = Glofitamab-L1_CD20/VK-CK

SEQ ID NO: 751 - protein, 232 aa, synthetic construct; identical to SEQ ID NO: 39
  REGION 1..232: note = Glofitamab-L2_CD3/VH-CL

SEQ ID NO: 752 - protein, 673 aa, synthetic construct; identical to SEQ ID NO: 40
  REGION 1..673: note = Glofitamab-H1_CD20/VH-CH1_CD3/VL-CH1

SEQ ID NO: 753 - protein, 448 aa, synthetic construct; identical to SEQ ID NO: 41
  REGION 1..448: note = Glofitamab-H2_CD20/VH-CH1

SEQ ID NO: 754 - protein, 219 aa, synthetic construct; identical to SEQ ID NO: 46
  REGION 1..219: note = Ob-L_CD20/VK-CK

SEQ ID NO: 755 - protein, 448 aa, synthetic construct; identical to SEQ ID NO: 47
  REGION 1..448: note = Ob-H_CD20/VH-CH1/knob/PGLALA

SEQ ID NO: 756 - protein, 111 aa, synthetic construct
  REGION 1..111: note = 9-K4A_VK
DIVLTQSPASLAVSLGQRATISCRASKSVSTSGYSYMHWYQQKPGQPPKLLIYLASNLESGVPARFSGSGSGTDFTLNIHPVEEEDAATYYCQHSRELPPTFGGGTKLEIK

SEQ ID NO: 757 - protein, 118 aa, synthetic construct
  REGION 1..118: note = 9-K4A_VH
QAYLQQSGAELVRPGASVKMSCKASGYTFPNYSFHWVKQTPRQGLEWIGAIYPGNDDTSYNQRFKGKATLTVDKSSSTAYMQLSSLTSEDSAVYFCARDYSNYPFDCWGQGTTLTVSS

SEQ ID NO: 758 - protein, 111 aa, synthetic construct; identical to SEQ ID NO: 756
  REGION 1..111: note = 5-P24_VK

SEQ ID NO: 759 - protein, 118 aa, synthetic construct
  REGION 1..118: note = 5-P24_VH
QAYLQQSGAELVRPGASVKMSCKASGYTFTSYSMHWVKQTPRQGLEWIGAIYPGNGDTSYTQKFKGKATLTVDKSSSTAYMQLSSLTSEDSAVYFCARDYSNYPFDYWGQGTTLTVSS

SEQ ID NO: 760 - protein, 111 aa, synthetic construct
  REGION 1..111: note = 3-P7A_VK
DIVLTQSPASLPVSLGQRATISCRASKSVSTSGYSYMHWYQQRPGQPPKLLIYLASNLESGVPARFSASGSGTDFTLNIHPVEEEDAATYYCQHSRELPPTFGGGTKVEIK

SEQ ID NO: 761 - protein, 118 aa, synthetic construct
  REGION 1..118: note = 3-P7A_VH
QAYLQQSGAELVRPGASVKMSCKASGYTFTSYSMHWVKQTPRQGLEWIGAIYPGNDDTSYNQKFKGKATLTVDKSSSTAYMQLSSLTSEDSAVYFCTRDYTNYPFDYWGQGTTLTVSS

SEQ ID NO: 762 - protein, 112 aa, synthetic construct
  REGION 1..112: note = 10-L12A_VK
DIVLTQSPASLAVSLGQRATISCRASKSVSTSGYSYLHWYQQKPGQPPKLLLIYLASNLESGVPARFSGSGSGTDFTLNIHPVEEEDAATYYCQHSRELPPTFGGGTKLEIK

SEQ ID NO: 763 - protein, 118 aa, synthetic construct
  REGION 1..118: note = 10-L12A_VH
QAYLQQSGAELVRPGASVKMSCKASGYTFTSYSMHWVKQTPRQGLEWIGAIYPGNGDTSYNQKFKGKATLTVDKSSSTAYMQLSSLTSEDSAVYFCTRDYSNYPFDYWGQGTTLTVSS

SEQ ID NO: 764 - protein, 723 aa, synthetic construct
  REGION 1..723: note = ACE2 ECD (18-740)
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVS

SEQ ID NO: 765 - protein, 723 aa, synthetic construct
  REGION 1..723: note = ACE2 ECD (18-740) R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVS

SEQ ID NO: 766 - protein, 723 aa, synthetic construct
  REGION 1..723: note = ACE2 ECD (18-740) R273A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVS

SEQ ID NO: 767 - protein, 723 aa, synthetic construct
  REGION 1..723: note = ACE2 ECD (18-740) R273G
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVS

SEQ ID NO: 768 - protein, 723 aa, synthetic construct
  REGION 1..723: note = ACE2 ECD (18-740) R273V
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVS

SEQ ID NO: 769 - protein, 723 aa, synthetic construct
  REGION 1..723: note = ACE2 ECD (18-740) H378A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVS

SEQ ID NO: 770 - protein, 723 aa, synthetic construct
  REGION 1..723: note = ACE2 ECD (18-740) E402A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVS

SEQ ID NO: 771 - protein, 598 aa, synthetic construct
  REGION 1..598: note = ACE2 PD (18-615)
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYAD

SEQ ID NO: 772 - protein, 598 aa, synthetic construct
  REGION 1..598: note = ACE2 PD (18-615) R273Q
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGQFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYAD

SEQ ID NO: 773 - protein, 598 aa, synthetic construct
  REGION 1..598: note = ACE2 PD (18-615) R273A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGAFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYAD

SEQ ID NO: 774 - protein, 598 aa, synthetic construct
  REGION 1..598: note = ACE2 PD (18-615) R273G
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGGFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYAD

SEQ ID NO: 775 - protein, 598 aa, synthetic construct
  REGION 1..598: note = ACE2 PD (18-615) R273V
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGVFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYAD

SEQ ID NO: 776 - protein, 598 aa, synthetic construct
  REGION 1..598: note = ACE2 PD (18-615) H378A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGAIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYAD

SEQ ID NO: 777 - protein, 598 aa, synthetic construct
  REGION 1..598: note = ACE2 PD (18-615) E402A
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHAAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYAD

SEQ ID NO: 778 - protein, 594 aa, synthetic construct
  REGION 1..594: note = ACE2 PD (18-611)
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWS

SEQ ID NO: 779 - protein, 590 aa, synthetic construct
  REGION 1..590: note = ACE2 PD (18-607)
QSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWS

SEQ ID NO: 780 - protein, 8 aa, synthetic construct
  REGION 1..8: note = ACE2 (608-615)
TDWSPYAD

SEQ ID NO: 781 - protein, 4 aa, synthetic construct
  REGION 1..4: note = ACE2 (608-611)
TDWS

SEQ ID NO: 782 - protein, 125 aa, synthetic construct
  REGION 1..125: note = ACE2 CLD (616-740) Dimerizing Polypeptide
QSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVS

SEQ ID NO: 783 - protein, 127 aa, synthetic construct
  REGION 1..127: note = Collectrin (TMEM27) Dimerizing Polypeptide (15-141)
ELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVP

SEQ ID NO: 784 - protein, 119 aa, synthetic construct
  REGION 1..119: note = Collectrin (TMEM27) Dimerizing Polypeptide (23-141) C75A
NAFKVRLSIRTALGDKAYAWDTNEEYLFKAMVAFSMRKVPNREATEISHVLLANVTQRVSFWFVVTDPSKNHTLPAVEVQSAIRMNKNRINNAFFLNDQTLEFLKIPSTLAPPMDPSVP

SEQ ID NO: 785 - protein, 127 aa, synthetic construct
  REGION 1..127: note = ACE2 (608-615)/Collectrin (23-141) C75A Dimerizing Polypeptide
TDWSPYADNAFKVRLSIRTALGDKAYAWDTNEEYLFKAMVAFSMRKVPNREATEISHVLLANVTQRVSFWFVVTDPSKNHTLPAVEVQSAIRMNKNRINNAFFLNDQTLEFLKIPSTLAPPMDPSVP

SEQ ID NO: 786 - protein, 131 aa, synthetic construct
  REGION 1..131: note = ACE2 (608-611)/Collectrin (15-141) Dimerizing Polypeptide
TDWSELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVP

SEQ ID NO: 787 - protein, 171 aa, synthetic construct
  REGION 1..171: note = TNFSF1 (LTA) (35-205) Trimerizing Polypeptide
LPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 788 - protein, 147 aa, synthetic construct
  REGION 1..147: note = TNFSF1 (LTA) (59-205) Trimerizing Polypeptide
STLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 789 - protein, 146 aa, synthetic construct
  REGION 1..146: note = TNFSF1 (LTA) (60-205) Trimerizing Polypeptide
TLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 790 - protein, 142 aa, synthetic construct
  REGION 1..142: note = TNFSF1 (LTA) (64-205) Trimerizing Polypeptide
AAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 791 - protein, 177 aa, synthetic construct
  REGION 1..177: note = TNFSF2 (TNF) (57-233) Trimerizing Polypeptide
GPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 792 - protein, 148 aa, synthetic construct
  REGION 1..148: note = TNFSF2 (TNF) (86-233) Trimerizing Polypeptide
DKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 793 - protein, 196 aa, synthetic construct
  REGION 1..196: note = TNFSF3 (LTB) (49-244) Trimerizing Polypeptide
QDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 794 - protein, 163 aa, synthetic construct
  REGION 1..163: note = TNFSF3 (LTB) (82-244) Trimerizing Polypeptide
DLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 795 - protein, 159 aa, synthetic construct
  REGION 1..159: note = TNFSF3 (LTB) (86-244) Trimerizing Polypeptide
GLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 796 - protein, 133 aa, synthetic construct
  REGION 1..133: note = TNFSF4 (OX40L) (51-183) Trimerizing Polypeptide
QVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 797 - protein, 132 aa, synthetic construct
  REGION 1..132: note = TNFSF4 (OX40L) (52-183) Trimerizing Polypeptide
VSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 798 - protein, 129 aa, synthetic construct
  REGION 1..129: note = TNFSF4 (OX40L) (55-183) Trimerizing Polypeptide
RYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 799 - protein, 215 aa, synthetic construct
  REGION 1..215: note = TNFSF5 (CD40L) (47-261) Trimerizing Polypeptide
HRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 800 - protein, 150 aa, synthetic construct
  REGION 1..150: note = TNFSF5 (CD40L) (112-261) Trimerizing Polypeptide
EMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 801 - protein, 145 aa, synthetic construct
  REGION 1..145: note = TNFSF5 (CD40L) (117-261) Trimerizing Polypeptide
DQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 802 - protein, 141 aa, synthetic construct
  REGION 1..141: note = TNFSF5 (CD40L) (121-261) Trimerizing Polypeptide
QIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 803 - protein, 179 aa, synthetic construct
  REGION 1..179: note = TNFSF6 (FASL, CD95L) (103-281) Trimerizing Polypeptide
QLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 804 - protein, 138 aa, synthetic construct
  REGION 1..138: note = TNFSF6 (FASL, CD95L) (144-281) Trimerizing Polypeptide
RKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 805 - protein, 137 aa, synthetic construct
  REGION 1..137: note = TNFSF6 (FASL, CD95L) (145-281) Trimerizing Polypeptide
KVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 806 - protein, 136 aa, synthetic construct
  REGION 1..136: note = TNFSF6 (FASL, CD95L) (146-281) Trimerizing Polypeptide
VAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 807 - protein, 155 aa, synthetic construct
  REGION 1..155: note = TNFSF7 (CD27L) (39-193) Trimerizing Polypeptide
QRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 808 - protein, 143 aa, synthetic construct
  REGION 1..143: note = TNFSF7 (CD27L) (51-193) Trimerizing Polypeptide
ESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 809 - protein, 138 aa, synthetic construct
  REGION 1..138: note = TNFSF7 (CD27L) (56-193) Trimerizing Polypeptide
DVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 810 - protein, 172 aa, synthetic construct
  REGION 1..172: note = TNFSF8 (CD30L) (63-234) Trimerizing Polypeptide
QRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 811 - protein, 138 aa, synthetic construct
  REGION 1..138: note = TNFSF8 (CD30L) (97-234) Trimerizing Polypeptide
KSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 812 - protein, 137 aa, synthetic construct
  REGION 1..137: note = TNFSF8 (CD30L) (98-234) Trimerizing Polypeptide
SWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 813 - protein, 133 aa, synthetic construct
  REGION 1..133: note = TNFSF8 (CD30L) (102-234) Trimerizing Polypeptide
LQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 814 - protein, 205 aa, synthetic construct
  REGION 1..205: note = TNFSF9 (4-1BBL) (50-254) Trimerizing Polypeptide
ACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 815 - protein, 184 aa, synthetic construct
  REGION 1..184: note = TNFSF9 (4-1BBL) (71-254) Trimerizing Polypeptide
REGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 816 - protein, 169 aa, synthetic construct
  REGION 1..169: note = TNFSF9 (4-1BBL) (86-254) Trimerizing Polypeptide
DLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 817 - protein, 243 aa, synthetic construct
  REGION 1..243: note = TNFSF10 (TRAIL) (39-281) Trimerizing Polypeptide
TNELKQMQDKYSKSGIACFLKEDDSYWDPNDEESMNSPCWQVKWQLRQLVRKMILRTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVG

SEQ ID NO: 818 - protein, 162 aa, synthetic construct
  REGION 1..162: note = TNFSF10 (TRAIL) (120-281) Trimerizing Polypeptide
QRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVG

SEQ ID NO: 819 - protein, 161 aa, synthetic construct
  REGION 1..161: note = TNFSF10 (TRAIL) (121-281) Trimerizing Polypeptide
RVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVG

SEQ ID NO: 820 - protein, 160 aa, synthetic construct
  REGION 1..160: note = TNFSF10 (TRAIL) (122-281) Trimerizing Polypeptide
VAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVG

SEQ ID NO: 821 - protein, 249 aa, synthetic construct
  REGION 1..249: note = TNFSF11 (RANKL) (69-317) Trimerizing Polypeptide
YFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 822 - protein, 157 aa, synthetic construct
  REGION 1..157: note = TNFSF11 (RANKL) (161-317) Trimerizing Polypeptide
EAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 823 - protein, 207 aa, synthetic construct
  REGION 1..207: note = TNFSF12 (TWEAK) (43-249) Trimerizing Polypeptide
SLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 824 - protein, 147 aa, synthetic construct
  REGION 1..147: note = TNFSF12 (TWEAK) (103-249) Trimerizing Polypeptide
ARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 825 - protein, 146 aa, synthetic construct
  REGION 1..146: note = TNFSF12 (TWEAK) (104-249) Trimerizing Polypeptide
RRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 826 - protein, 145 aa, synthetic construct
  REGION 1..145: note = TNFSF12 (TWEAK) (105-249) Trimerizing Polypeptide
RAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 827 - protein, 144 aa, synthetic construct
  REGION 1..144: note = TNFSF12 (TWEAK) (106-249) Trimerizing Polypeptide
AIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 828 - protein, 143 aa, synthetic construct
  REGION 1..143: note = TNFSF13 (APRIL1) (105-247) Trimerizing Polypeptide
AVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGF

SEQ ID NO: 829 - protein, 136 aa, synthetic construct
  REGION 1..136: note = TNFSF13 (APRIL1) (112-247) Trimerizing Polypeptide
KKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGF

SEQ ID NO: 830 - protein, 146 aa, synthetic construct
  REGION 1..146: note = TNFSF13 (APRIL2) (105-250) Trimerizing Polypeptide
AVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 831 - protein, 139 aa, synthetic construct
  REGION 1..139: note = TNFSF13 (APRIL2) (112-250) Trimerizing Polypeptide
KKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 832 - protein, 218 aa, synthetic construct
  REGION 1..218: note = TNFSF13B (BAFF) (68-285) Trimerizing Polypeptide
QVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 833 - protein, 146 aa, synthetic construct
  REGION 1..146: note = TNFSF13B (BAFF) (140-285) Trimerizing Polypeptide
ETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 834 - protein, 182 aa, synthetic construct
  REGION 1..182: note = TNFSF14 (LIGHT) (59-240) Trimerizing Polypeptide
LQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 835 - protein, 148 aa, synthetic construct
  REGION 1..148: note = TNFSF14 (LIGHT) (93-240) Trimerizing Polypeptide
NPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 836 - protein, 147 aa, synthetic construct
  REGION 1..147: note = TNFSF14 (LIGHT) (94-240) Trimerizing Polypeptide
PAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 837 - protein, 146 aa, synthetic construct
  REGION 1..146: note = TNFSF14 (LIGHT) (95-240) Trimerizing Polypeptide
AAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 838 - protein, 195 aa, synthetic construct
  REGION 1..195: note = TNFSF15 (TL1) (57-251) Trimerizing Polypeptide
SQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 839 - protein, 161 aa, synthetic construct
  REGION 1..161: note = TNFSF15 (TL1) (91-251) Trimerizing Polypeptide
DGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 840 - protein, 159 aa, synthetic construct
  REGION 1..159: note = TNFSF15 (TL1) (93-251) Trimerizing Polypeptide
DKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 841 - protein, 155 aa, synthetic construct
  REGION 1..155: note = TNFSF15 (TL1) (97-251) Trimerizing Polypeptide
AHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 842 - protein, 128 aa, synthetic construct
  REGION 1..128: note = TNFSF18 (GITRL) (72-199) Trimerizing Polypeptide
QLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 843 - protein, 126 aa, synthetic construct
  REGION 1..126: note = TNFSF18 (GITRL) (74-199) Trimerizing Polypeptide
ETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 844 - protein, 582 aa, synthetic construct
  REGION 1..582: note = sc4-1BBL
GGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGGGGSGGGGSREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 845 - protein, 420 aa, synthetic construct
  REGION 1..420: note = scOX40L
GGGSGGGQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGGSGGGQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVLGGGSGGGQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 846 - protein, 414 aa, synthetic construct
  REGION 1..414: note = scGITRL
GGSGGGGSGGQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFISGGSGGGGSGGQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFISGGSGGGGSGGQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 847 - protein, 159 aa, synthetic construct
  REGION 1..159: note = IL1A (P01583) ECD
SAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLAGGPPSITDFQILENQA

SEQ ID NO: 848 - protein, 153 aa, synthetic construct
  REGION 1..153: note = IL1B (P01584) ECD
APVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 849 - protein, 133 aa, synthetic construct [sequence omitted]

SEQ ID NO: 850 - protein, 133 aa, synthetic construct
  REGION 1..133: note = IL3 (P08700) ECD
APMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 851 - protein, 129 aa, synthetic construct [sequence omitted]

SEQ ID NO: 852 - protein, 115 aa, synthetic construct
  REGION 1..115: note = IL5 (P05113) ECD
IPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 853 - protein, 183 aa, synthetic construct
  REGION 1..183: note = IL6 (P05231) ECD
VPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 854 - protein, 152 aa, synthetic construct
  REGION 1..152: note = IL7 (P13232) ECD
DCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 855 - protein, 79 aa, synthetic construct
  REGION 1..79: note = IL8 (P10145) ECD
EGAVLPRSAKELRCQCIKTYSKPFHPKFIKELRVIESGPHCANTEIIVKLSDGRELCLDPKENWVQRVVEKFLKRAENS

SEQ ID NO: 856 - protein, 230 aa, synthetic construct
  REGION 1..230: note = IL9 (Q01113) ECD
SVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWP

SEQ ID NO: 857 - protein, 160 aa, synthetic construct
  REGION 1..160: note = IL10 (P22301) ECD
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 858 - protein, 178 aa, synthetic construct
  REGION 1..178: note = IL11 (P20809) ECD
PGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 859 - protein, 197 aa, synthetic construct
  REGION 1..197: note = IL12A (P29459) ECD
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 860 - protein, 306 aa, synthetic construct
  REGION 1..306: note = IL12B (P29460) ECD
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 861 - protein, 122 aa, synthetic construct
  REGION 1..122: note = IL13 (P35225) ECD
LTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFN

SEQ ID NO: 862 - protein, 114 aa, synthetic construct
  REGION 1..114: note = IL15 (P40933) ECD
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 863 - protein, 121 aa, synthetic construct
  REGION 1..121: note = IL16 (Q14005) ECD
SAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 864 - protein, 132 aa, synthetic construct
  REGION 1..132: note = IL17A (Q16552) ECD
GITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 865 - protein, 160 aa, synthetic construct
  REGION 1..160: note = IL17B (Q9UHF5) ECD
QPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 866 - protein, 179 aa, synthetic construct
  REGION 1..179: note = IL17C (Q9P0M4) ECD
HHDPSLRGHPHSHGTPHCYSAEELPLGQAPPHLLARGAKWGQALPVALVSSLEAASHRGRHERPSATTQCPVLRPEEVLEADTHQRSISPWRYRVDTDEDRYPQKLAFAECLCRGCIDARTGRETAALNSVRLLQSLLVLRRRPCSRDGSGLPTPGAFAFHTEFIHVPVGCTCVLPRSV

SEQ ID NO: 867 - protein, 187 aa, synthetic construct
  REGION 1..187: note = IL17D (Q8TAD2) ECD
AGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 868 - protein, 133 aa, synthetic construct [sequence omitted]

SEQ ID NO: 869 - protein, 157 aa, synthetic construct
  REGION 1..157: note = IL18 (Q14116) ECD
YFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 870 - protein, 153 aa, synthetic construct
  REGION 1..153: note = IL19 (Q9UHD0) ECD
LRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 871 - protein, 152 aa, synthetic construct
  REGION 1..152: note = IL20 (Q9NYY1) ECD
LKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCHAHMTCHCGEEAMKKYSQILSHFEKLEPQAAVVKALGELDILLQWMEETE

SEQ ID NO: 872 - protein, 138 aa, synthetic construct
  REGION 1..138: note = IL21 (Q9HBE4) ECD
HKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 873 - protein, 146 aa, synthetic construct
  REGION 1..146: note = IL22 (Q9GZX6) ECD
APISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 874 - protein, 332 aa, synthetic construct
  REGION 1..332: note = IL23R (Q5VWK5) ECD
GITNINCSGHIWVEPATIFKMGMNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWNVKEFDTNFTYVQQSEFYLEPNIKYVFQVRCQETGKRYWQPWSSLFFHKTPETVPQVTSKAFQHDTWNSGLTVASISTGHLTSDNRGDIG

SEQ ID NO: 875 - protein, 170 aa, synthetic construct
  REGION 1..170: note = IL23A (Q9NPF7) ECD
RAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 876 - protein, 155 aa, synthetic construct
  REGION 1..155: note = IL24 (Q13007) ECD
QEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 877 - protein, 145 aa, synthetic construct
  REGION 1..145: note = IL25 (Q9H293) ECD
YSHWPSCCPSKGQDTSEELLRWSTVPVPPLEPARPNRHPESCRASEDGPLNSRAISPWRYELDRDLNRLPQDLYHARCLCPHCVSLQTGSHMDPRGNSELLYHNQTVFYRRPCHGEKGTHKGYCLERRLYRVSLACVCVRPRVMG

SEQ ID NO: 878 - protein, 150 aa, synthetic construct
  REGION 1..150: note = IL26 (Q9NPH9) ECD
KHKQSSFTKSCYPRGTLSQAVDALYIKAAWLKATIPEDRIKNIRLLKKKTKKQFMKNCQFQEQLLSFFMEDVFGQLQLQGCKKIRFVEDFHSLRQKLSHCISCASSAREMKSITRMKRIFYRIGNKGIYKAISELDILLSWIKKLLESSQ

SEQ ID NO: 879 - protein, 215 aa, synthetic construct
  REGION 1..215: note = IL27A (Q8NEV9) ECD
FPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 880 - protein, 209 aa, synthetic construct
  REGION 1..209: note = IL27B (Q14213) ECD
RKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 881 - protein, 181 aa, synthetic construct
  REGION 1..181: note = IL29 (Q8IU54) ECD
GPVPTSKPTTTGKGCHIGRFKSLSPQELASFKKARDALEESLKLKNWSCSSPVFPGNWDLRLLQVRERPVALEAELALTLKVLEAAAGPALEDVLDQPLHTLHHILSQLQACIQPQPTAGPRPRGRLHHWLHRLQEAPKKESAGCLEASVTFNLFRLLTRDLKYVADGNLCLRTSTHPEST

SEQ ID NO: 882 - protein, 141 aa, synthetic construct [sequence omitted]

SEQ ID NO: 883 - protein, 204 aa, synthetic construct
  REGION 1..204: note = IL32 (P24001) ECD
AWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 884 - protein, 176 aa, synthetic construct
  REGION 1..176: note = IL33 (O95760) ECD
AFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 885 - protein, 222 aa, synthetic construct
  REGION 1..222: note = IL34 (Q6ZMJ4) ECD
NEPLEMWPLTQNEECTVTGFLRDKLQYRSRLQYMKHYFPINYKISVPYEGVFRIANVTRLQRAQVSERELRYLWVLVSLSATESVQDVLLEGHPSWKYLQEVETLLLNVQQGLTDVEVSPKVESVLSLLNAPGPNLKLVRPKALLDNCFRVMELLYCSCCKQSSVLNWQDCEVPSPQSCSPEPSLQYAATQLYPPPPWSPSSPPHSTGSVRPVRAQGEGLLP

SEQ ID NO: 886 - protein, 153 aa, synthetic construct
  REGION 1..153: note = IL36A (Q9UHA7) ECD
KIDTPQQGSIQDINHRVWVLQDQTLIAVPRKDRMSPVTIALISCRHVETLEKDRGNPIYLGLNGLNLCLMCAKVGDQPTLQLKEKDIMDLYNQPEPVKSFLFYHSQSGRNSTFESVAFPGWFIAVSSEGGCPLILTQELGKANTTDFGLTMLF

SEQ ID NO: 887 - protein, 160 aa, synthetic construct
  REGION 1..160: note = IL36B (Q9NZH7 ) ECD
REAAPKSYAIRDSRQMVWVLSGNSLIAAPLSRSIKPVTLHLIACRDTEFSDKEKGNMVYLGIKGKDLCLFCAEIQGKPTLQLKLQGSQDNIGKDTCWKLVGIHTCINLDVRESCFMGTLDQWGIGVGRKKWKSSFQHHHLRKKDKDFSSMRTNIGMPGRM

SEQ ID NO: 888 - protein, 152 aa, synthetic construct
  REGION 1..152: note = IL36G (Q9NZH8 ) ECD
SMCKPITGTINDLNQQVWTLQGQNLVAVPRSDSVTPVTVAVITCKYPEALEQGRGDPIYLGIQNPEMCLYCEKVGEQPTLQLKEQKIMDLYGQPEPVKPFLFYRAKTGRTSTLESVAFPDWFIASSKRDQPIILTSELGKSYNTAFELNIND

SEQ ID NO: 889 - protein, 173 aa, synthetic construct
  REGION 1..173: note = IL37 (Q9NZH6 ) ECD
VHTSPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 890 - protein, 245 aa, synthetic construct
  REGION 1..245: note = IL40 (Q6UX52 ) ECD
REEEITPVVSIAYKVLEVFPKGRWVLITCCAPQPPPPITYSLCGTKNIKVAKKVVKTHEPASFNLNVTLKSSPDLLTYFCWASSTSGAHVDSARLQMHWELWSKPVSELRANFTLQDRGAGPRVEMICQASSGSPPITNSLIGKDGQVHLQQRPCHRQPANFSFLPSQTSDWFWCQAANNANVQHSALTVVPPGGDQKMEDWQGPLESPILALPLYRSTRRLSEEEFGGFRIGNGEVRGRKAAAM

SEQ ID NO: 891 - protein, 271 aa, synthetic construct
  REGION 1..271: note = IL1A (P01583) SP+PP+ECD
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLAGGPPSITDFQILENQA

SEQ ID NO: 892 - protein, 269 aa, synthetic construct
  REGION 1..269: note = IL1B (P01584) SP+PP+ECD
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 893 - protein, 153 aa, synthetic construct
  REGION 1..153: note = IL2 (P60568) SP+PP+ECD
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 894 - protein, 152 aa, synthetic construct
  REGION 1..152: note = IL3 (P08700) SP+PP+ECD
MSRLPVLLLLQLLVRPGLQAPMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 895 - protein, 153 aa, synthetic construct [sequence omitted]

SEQ ID NO: 896 - protein, 134 aa, synthetic construct
  REGION 1..134: note = IL5 (P05113) SP+PP+ECD
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 897 - protein, 212 aa, synthetic construct
  REGION 1..212: note = IL6 (P05231) SP+PP+ECD
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 898 - protein, 177 aa, synthetic construct
  REGION 1..177: note = IL7 (P13232) SP+PP+ECD
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 899 - protein, 99 aa, synthetic construct
  REGION 1..99: note = IL8 (P10145) SP+PP+ECD
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 900 - protein, 270 aa, synthetic construct
  REGION 1..270: note = IL9 (Q01113) SP+PP+ECD
MGLGRCIWEGWTLESEALRRDMGTWLLACICICTCVCLGVSVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWP

SEQ ID NO: 901 - protein, 178 aa, synthetic construct
  REGION 1..178: note = IL10 (P22301) SP+PP+ECD
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 902 - protein, 199 aa, synthetic construct
  REGION 1..199: note = IL11 (P20809) SP+PP+ECD
MNCVCRLVLVVLSLWPDTAVAPGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 903 - protein, 219 aa, synthetic construct
  REGION 1..219: note = IL12A (P29459) SP+PP+ECD
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 904 - protein, 328 aa, synthetic construct
  REGION 1..328: note = IL12B (P29460) SP+PP+ECD
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 905 - protein, 146 aa, synthetic construct [sequence omitted]

SEQ ID NO: 906 - protein, 162 aa, synthetic construct
  REGION 1..162: note = IL15 (P40933) SP+PP+ECD
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 907 - protein, 1332 aa, synthetic construct
  REGION 1..1332: note = IL16 (Q14005) SP+PP+ECD
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 908 - protein, 155 aa, synthetic construct
  REGION 1..155: note = IL17A (Q16552) SP+PP+ECD
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 909 - protein, 180 aa, synthetic construct
  REGION 1..180: note = IL17B (Q9UHF5) SP+PP+ECD
MDWPHNLLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 910 - protein, 197 aa, synthetic construct
  REGION 1..197: note = IL17C (Q9P0M4) SP+PP+ECD
MTLLPGLLFLTWLHTCLAHHDPSLRGHPHSHGTPHCYSAEELPLGQAPPHLLARGAKWGQALPVALVSSLEAASHRGRHERPSATTQCPVLRPEEVLEADTHQRSISPWRYRVDTDEDRYPQKLAFAECLCRGCIDARTGRETAALNSVRLLQSLLVLRRRPCSRDGSGLPTPGAFAFHTEFIHVPVGCTCVLPRSV

SEQ ID NO: 911 - protein, 202 aa, synthetic construct
  REGION 1..202: note = IL17D (Q8TAD2) SP+PP+ECD
MLVAGFLLALPPSWAAGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 912 - protein, 163 aa, synthetic construct
  REGION 1..163: note = IL17F (Q96PD4) SP+PP+ECD
MTVKTLHGPAMVKYLLLSILGLAFLSEAAARKIPKVGHTFFQKPESCPPVPGGSMKLDIGIINENQRVSMSRNIESRSTSPWNYTVTWDPNRYPSEVVQAQCRNLGCINAQGKEDISMNSVPIQQETLVVRRKHQGCSVSFQLEKVLVTVGCTCVTPVIHHVQ

SEQ ID NO: 913 - protein, 193 aa, synthetic construct
  REGION 1..193: note = IL18 (Q14116) SP+PP+ECD
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 914 - protein, 177 aa, synthetic construct
  REGION 1..177: note = IL19 (Q9UHD0) SP+PP+ECD
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 915 - protein, 176 aa, synthetic construct
  REGION 1..176: note = IL20 (Q9NYY1) SP+PP+ECD
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCHAHMTCHCGEEAMKKYSQILSHFEKLEPQAAVVKALGELDILLQWMEETE

SEQ ID NO: 916 - protein, 162 aa, synthetic construct
  REGION 1..162: note = IL21 (Q9HBE4) SP+PP+ECD
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 917 - protein, 179 aa, synthetic construct
  REGION 1..179: note = IL22 (Q9GZX6) SP+PP+ECD
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 918 - protein, 629 aa, synthetic construct
  REGION 1..629: note = IL23R (Q5VWK5) SP+PP+ECD
MNQVTIQWDAVIALYILFSWCHGGITNINCSGHIWVEPATIFKMGMNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWNVKEFDTNFTYVQQSEFYLEPNIKYVFQVRCQETGKRYWQPWSSLFFHKTPETVPQVTSKAFQHDTWNSGLTVASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 919 - protein, 189 aa, synthetic construct
  REGION 1..189: note = IL23A (Q9NPF7) SP+PP+ECD
MLGSRAVMLLLLLPWTAQGRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 920 - protein, 206 aa, synthetic construct
  REGION 1..206: note = IL24 (Q13007) SP+PP+ECD
MNFQQRLQSLWTLARPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 921 - protein, 177 aa, synthetic construct
  REGION 1..177: note = IL25 (Q9H293) SP+PP+ECD
MRERPRLGEDSSLISLFLQVVAFLAMVMGTHTYSHWPSCCPSKGQDTSEELLRWSTVPVPPLEPARPNRHPESCRASEDGPLNSRAISPWRYELDRDLNRLPQDLYHARCLCPHCVSLQTGSHMDPRGNSELLYHNQTVFYRRPCHGEKGTHKGYCLERRLYRVSLACVCVRPRVMG

SEQ ID NO: 922 - protein, 171 aa, synthetic construct
  REGION 1..171: note = IL26 (Q9NPH9) SP+PP+ECD
MLVNFILRCGLLLVTLSLAIAKHKQSSFTKSCYPRGTLSQAVDALYIKAAWLKATIPEDRIKNIRLLKKKTKKQFMKNCQFQEQLLSFFMEDVFGQLQLQGCKKIRFVEDFHSLRQKLSHCISCASSAREMKSITRMKRIFYRIGNKGIYKAISELDILLSWIKKLLESSQ

SEQ ID NO: 923 - protein, 243 aa, synthetic construct
  REGION 1..243: note = IL27A (Q8NEV9) SP+PP+ECD
MGQTAGDLGWRLSLLLLPLLLVQAGVWGFPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 924 - protein, 229 aa, synthetic construct
  REGION 1..229: note = IL27B (Q14213) SP+PP+ECD
MTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 925 - protein, 200 aa, synthetic construct
  REGION 1..200: note = IL29 (Q8IU54) SP+PP+ECD
MAAAWTVVLVTLVLGLAVAGPVPTSKPTTTGKGCHIGRFKSLSPQELASFKKARDALEESLKLKNWSCSSPVFPGNWDLRLLQVRERPVALEAELALTLKVLEAAAGPALEDVLDQPLHTLHHILSQLQACIQPQPTAGPRPRGRLHHWLHRLQEAPKKESAGCLEASVTFNLFRLLTRDLKYVADGNLCLRTSTHPEST

SEQ ID NO: 926 - protein, 164 aa, synthetic construct
  REGION 1..164: note = IL31 (Q6EBC2) SP+PP+ECD
MASHSGPSTSVLFLFCCLGGWLASHTLPVRLLRPSDDVQKIVEELQSLSKMLLKDVEEEKGVLVSQNYTLPCLSPDAQPPNNIHSPAIRAYLKTIRQLDNKSVIDEIIEHLDKLIFQDAPETNISVPTDTHECKRFILTISQQFSECMDLALKSLTSGAQQATT

SEQ ID NO: 927 - protein, 234 aa, synthetic construct
  REGION 1..234: note = IL32 (P24001) SP+PP+ECD
MCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 928 - protein, 270 aa, synthetic construct
  REGION 1..270: note = IL33 (O95760) SP+PP+ECD
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 929 - protein, 242 aa, synthetic construct
  REGION 1..242: note = IL34 (Q6ZMJ4) SP+PP+ECD
MPRGFTWLRYLGIFLGVALGNEPLEMWPLTQNEECTVTGFLRDKLQYRSRLQYMKHYFPINYKISVPYEGVFRIANVTRLQRAQVSERELRYLWVLVSLSATESVQDVLLEGHPSWKYLQEVETLLLNVQQGLTDVEVSPKVESVLSLLNAPGPNLKLVRPKALLDNCFRVMELLYCSCCKQSSVLNWQDCEVPSPQSCSPEPSLQYAATQLYPPPPWSPSSPPHSTGSVRPVRAQGEGLLP

SEQ ID NO: 930 - protein, 158 aa, synthetic construct
  REGION 1..158: note = IL36A (Q9UHA7) SP+PP+ECD
MEKALKIDTPQQGSIQDINHRVWVLQDQTLIAVPRKDRMSPVTIALISCRHVETLEKDRGNPIYLGLNGLNLCLMCAKVGDQPTLQLKEKDIMDLYNQPEPVKSFLFYHSQSGRNSTFESVAFPGWFIAVSSEGGCPLILTQELGKANTTDFGLTMLF

SEQ ID NO: 931 - protein, 164 aa, synthetic construct
  REGION 1..164: note = IL36B (Q9NZH7 ) SP+PP+ECD
MNPQREAAPKSYAIRDSRQMVWVLSGNSLIAAPLSRSIKPVTLHLIACRDTEFSDKEKGNMVYLGIKGKDLCLFCAEIQGKPTLQLKLQGSQDNIGKDTCWKLVGIHTCINLDVRESCFMGTLDQWGIGVGRKKWKSSFQHHHLRKKDKDFSSMRTNIGMPGRM

SEQ ID NO: 932 - protein, 169 aa, synthetic construct
  REGION 1..169: note = IL36G (Q9NZH8 ) SP+PP+ECD
MRGTPGDADGGGRAVYQSMCKPITGTINDLNQQVWTLQGQNLVAVPRSDSVTPVTVAVITCKYPEALEQGRGDPIYLGIQNPEMCLYCEKVGEQPTLQLKEQKIMDLYGQPEPVKPFLFYRAKTGRTSTLESVAFPDWFIASSKRDQPIILTSELGKSYNTAFELNIND

SEQ ID NO: 933 - protein, 218 aa, synthetic construct
  REGION 1..218: note = IL37 (Q9NZH6 ) SP+PP+ECD
MSFVGENSGVKMGSEDWEKDEPQCCLEDPAGSPLEPGPSLPTMNFVHTSPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 934 - protein, 265 aa, synthetic construct
  REGION 1..265: note = IL40 (Q6UX52 ) SP+PP+ECD
MGLPGLFCLAVLAASSFSKAREEEITPVVSIAYKVLEVFPKGRWVLITCCAPQPPPPITYSLCGTKNIKVAKKVVKTHEPASFNLNVTLKSSPDLLTYFCWASSTSGAHVDSARLQMHWELWSKPVSELRANFTLQDRGAGPRVEMICQASSGSPPITNSLIGKDGQVHLQQRPCHRQPANFSFLPSQTSDWFWCQAANNANVQHSALTVVPPGGDQKMEDWQGPLESPILALPLYRSTRRLSEEEFGGFRIGNGEVRGRKAAAM

SEQ ID NO: 935 - protein, 1227 aa, synthetic construct
  REGION 1..1227: note = ACE (P12821) ECD
LDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQAR

SEQ ID NO: 936 - protein, 723 aa, synthetic construct; identical to SEQ ID NO: 764
  REGION 1..723: note = ACE2 (Q9BYF1) ECD

SEQ ID NO: 937 - protein, 350 aa, synthetic construct
  REGION 1..350: note = ACP2 (P11117) ECD
RSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTE

SEQ ID NO: 938 - protein, 367 aa, synthetic construct
  REGION 1..367: note = ACPT (Q9BZG2) ECD
LPEGPLVFVALVFRHGDRAPLASYPMDPHKEVASTLWPRGLGQLTTEGVRQQLELGRFLRSRYEAFLSPEYRREEVYIRSTDFDRTLESAQANLAGLFPEAAPGSPEARWRPIPVHTVPVAEDKLLRFPMRSCPRYHELLREATEAAEYQEALEGWTGFLSRLENFTGLSLVGEPLRRAWKVLDTLMCQQAHGLPLPAWASPDVLRTLAQISALDIGAHVGPPRAAEKAQLTGGILLNAILANFSRVQRLGLPLKMVMYSAHDSTLLALQGALGLYDGHTPPYAACLGFEFRKHLGNPAKDGGNVTVSLFYRNDSAHLPLPLSLPGCPAPCPLGRFYQLTAPARPPAHGVSCHGPYEAAIPPAPVVP

SEQ ID NO: 939 - protein, 103 aa, synthetic construct
  REGION 1..103: note = ACVR1 (Q04771) ECD
MEDEKPKVNPKLYMCVCEGLSCGNEDHCEGQQCFSSLSINDGFHVYQKGCFQVYEQGKMTCKTPPSPGQAVECCQGDWCNRNITAQLPTKGKSFPGTQNFHLE

SEQ ID NO: 940 - protein, 103 aa, synthetic construct
  REGION 1..103: note = ACVR1B (P36896) ECD
SGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVE

SEQ ID NO: 941 - protein, 92 aa, synthetic construct
  REGION 1..92: note = ACVR1C (Q8NER5) ECD
LSPGLKCVCLLCDSSNFTCQTEGACWASVMLTNGKEQVIKSCVSLPELNAQVFCHSSNNVTKTECCFTDFCNNITLHLPTASPNAPKLGPME

SEQ ID NO: 942 - protein, 116 aa, synthetic construct
  REGION 1..116: note = ACVR2A (P27037) ECD
AILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPP

SEQ ID NO: 943 - protein, 119 aa, synthetic construct
  REGION 1..119: note = ACVR2B (Q13705) ECD
SGRGEAETRECIYYNANWELERTNQSGLERCEGEQDKRLHCYASWRNSSGTIELVKKGCWLDDFNCYDRQECVATEENPQVYFCCCEGNFCNERFTHLPEAGGPEVTYEPPPTAPTLLT

SEQ ID NO: 944 - protein, 97 aa, synthetic construct
  REGION 1..97: note = ACVRL1 (P37023) ECD
DPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQ

SEQ ID NO: 945 - protein, 653 aa, synthetic construct
  REGION 1..653: note = ADAM10 (O14672) ECD
QYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAE

SEQ ID NO: 946 - protein, 509 aa, synthetic construct
  REGION 1..509: note = ADAM11 (O75078) ECD
QVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTN

SEQ ID NO: 947 - protein, 501 aa, synthetic construct
  REGION 1..501: note = ADAM12 (O43184) ECD
ETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQG

SEQ ID NO: 948 - protein, 490 aa, synthetic construct
  REGION 1..490: note = ADAM15 (Q13444) ECD
DVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTT

SEQ ID NO: 949 - protein, 457 aa, synthetic construct
  REGION 1..457: note = ADAM17 (P78536) ECD
RADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADN

SEQ ID NO: 950 - protein, 511 aa, synthetic construct
  REGION 1..511: note = ADAM18 (Q9Y3Q7) ECD
NLSKLLPQYLEIYIIVEKALYDYMGSEMMAVTQKIVQVIGLVNTMFTQFKLTVILSSLELWSNENQISTSGDADDILQRFLAWKRDYLILRPHDIAYLLVYRKHPKYVGATFPGTVCNKSYDAGIAMYPDAIGLEGFSVIIAQLLGLNVGLTYDDITQCFCLRATCIMNHEAVSASGRKIFSNCSMHDYRYFVSKFETKCLQKLSNLQPLHQNQPVCGNGILESNEECDCGNKNECQFKKCCDYNTCKLKGSVKCGSGPCCTSKCELSIAGTPCRKSIDPECDFTEYCNGTSSNCVPDTYALNGRLCKLGTAYCYNGQCQTTDNQCAKIFGKGAQGAPFACFKEVNSLHERSENCGFKNSQPLPCERKDVLCGKLACVQPHKNANKSDAQSTVYSYIQDHVCVSIATGSSMRSDGTDNAYVADGTMCGPEMYCVNKTCRKVHLMGYNCNATTKCKGKGICNNFGNCQCFPGHRPPDCKFQFGSPGGSIDDGNFQKSGDFYTEKGYNTHWNN

SEQ ID NO: 951 - protein, 497 aa, synthetic construct
  REGION 1..497: note = ADAM19 (Q9H013) ECD
REDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPES

SEQ ID NO: 952 - protein, 512 aa, synthetic construct
  REGION 1..512: note = ADAM2 (Q99965) ECD
DFAKYIEMHVIVEKQLYNHMGSDTTVVAQKVFQLIGLTNAIFVSFNITIILSSLELWIDENKIATTGEANELLHTFLRWKTSYLVLRPHDVAFLLVYREKSNYVGATFQGKMCDANYAGGVVLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADNLQCGKLICKYVGKFLLQIPRATIIYANISGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMR

SEQ ID NO: 953 - protein, 487 aa, synthetic construct
  REGION 1..487: note = ADAM20 (O43506) ECD
RFVELVVVVDNIRYLFSQSNATTVQHEVFNVVNIVDSFYHPLEVDVILTGIDIWTASNPLPTSGDLDNVLEDFSIWKNYNLNNRLQHDVAHLFIKDTQGMKLGVAYVKGICQNPFNTGVDVFEDNRLVVFAITLGHELGHNLGMQHDTQWCVCELQWCIMHAYRKVTTKFSNCSYAQYWDSTISSGLCIQPPPYPGNIFRLKYCGNLVVEEGEECDCGTIRQCAKDPCCLLNCTLHPGAACAFGICCKDCKFLPSGTLCRQQVGECDLPEWCNGTSHQCPDDVYVQDGISCNVNAFCYEKTCNNHDIQCKEIFGQDARSASQSCYQEINTQGNRFGHCGIVGTTYVKCWTPDIMCGRVQCENVGVIPNLIEHSTVQQFHLNDTTCWGTDYHLGMAIPDIGEVKDGTVCGPEKICIRKKCASMVHLSQACQPKTCNMRGICNNKQHCHCNHEWAPPYCKDKGYGGSADSGPPPKNNMEGLNVMGKLRY

SEQ ID NO: 954 - protein, 485 aa, synthetic construct
  REGION 1..485: note = ADAM21 (Q9UKJ8) ECD
PKSAGDWWTHAWFLELVVVVNHDFFIYSQSNISKVQEDVFLVVNIVDSMYKQLGTYIILIGIEIWNQGNVFPMTSIEQVLNDFSQWKQISLSQLQHDAAHMFIKNSLISILGLAYVAGICRPPIDCGVDNFQGDTWSLFANTVAHELGHTLGMQHDEEFCFCGERGCIMNTFRVPAEKFTNCSYADFMKTTLNQGSCLHNPPRLGEIFMLKRCGNGVVEREEQCDCGSVQQCEQDACCLLNCTLRPGAACAFGLCCKDCKFMPSGELCRQEVNECDLPEWCNGTSHQCPEDRYVQDGIPCSDSAYCYQKRCNNHDQHCREIFGKDAKSASQNCYKEINSQGNRFGHCGINGTTYLKCHISDVFCGRVQCENVRDIPLLQDHFTLQHTHINGVTCWGIDYHLRMNISDIGEVKDGTVCGPGKICIHKKCVSLSVLSHVCLPETCNMKGICNNKHHCHCGYGWSPPYCQHRGYGGSIDSGPASAKRG

SEQ ID NO: 955 - protein, 514 aa, synthetic construct
  REGION 1..514: note = ADAM22 (Q9P0K1) ECD
SKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTN

SEQ ID NO: 956 - protein, 506 aa, synthetic construct
  REGION 1..506: note = ADAM23 (O75077) ECD
AVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKGKVCSGHGVCSNEATCICDFTWAGTDCSIRDPVRNLHPPKDEGPKGPSATN

SEQ ID NO: 957 - protein, 467 aa, synthetic construct
  REGION 1..467: note = ADAM28 (Q9UKQ2) ECD
VQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHF

SEQ ID NO: 958 - protein, 481 aa, synthetic construct
  REGION 1..481: note = ADAM29 (Q9UKF5) ECD
WIHFRIVEIVVVIDNYLYIRYERNDSKLLEDLYVIVNIVDSILDVIGVKVLLFGLEIWTNKNLIVVDDVRKSVHLYCKWKSENITPRMQHDTSHLFTTLGLRGLSGIGAFRGMCTPHRSCAIVTFMNKTLGTFSIAVAHHLGHNLGMNHDEDTCRCSQPRCIMHEGNPPITKFSNCSYGDFWEYTVERTKCLLETVHTKDIFNVKRCGNGVVEEGEECDCGPLKHCAKDPCCLSNCTLTDGSTCAFGLCCKDCKFLPSGKVCRKEVNECDLPEWCNGTSHKCPDDFYVEDGIPCKERGYCYEKSCHDRNEQCRRIFGAGANTASETCYKELNTLGDRVGHCGIKNATYIKCNISDVQCGRIQCENVTEIPNMSDHTTVHWARFNDIMCWSTDYHLGMKGPDIGEVKDGTECGIDHICIHRHCVHITILNSNCSPAFCNKRGICNNKHHCHCNYLWDPPNCLIKGYGGSVDSGPPPKRKKKK

SEQ ID NO: 959 - protein, 489 aa, synthetic construct
  REGION 1..489: note = ADAM30 (Q9UKF2) ECD
YKHPKYLELILLFDQSRYRFVNNNLSQVIHDAILLTGIMDTYFQDVRMRIHLKALEVWTDFNKIRVGYPELAEVLGRFVIYKKSVLNARLSSDWAHLYLQRKYNDALAWSFGKVCSLEYAGSVSTLLDTNILAPATWSAHELGHAVGMSHDEQYCQCRGRLNCIMGSGRTGFSNCSYISFFKHISSGATCLNNIPGLGYVLKRCGNKIVEDNEECDCGSTEECQKDRCCQSNCKLQPGANCSIGLCCHDCRFRPSGYVCRQEGNECDLAEYCDGNSSSCPNDVYKQDGTPCKYEGRCFRKGCRSRYMQCQSIFGPDAMEAPSECYDAVNLIGDQFGNCEITGIRNFKKCESANSICGRLQCINVETIPDLPEHTTIISTHLQAENLMCWGTGYHLSMKPMGIPDLGMINDGTSCGEGRVCFKKNCVNSSVLQFDCLPEKCNTRGVCNNRKNCHCMYGWAPPFCEEVGYGGSIDSGPPGLLRGAIPSSIW

SEQ ID NO: 960 - protein, 508 aa, synthetic construct
  REGION 1..508: note = ADAM32 (Q8TC27) ECD
KSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALYPKEITLEAFAVIVTQMLALSLGISYDDPKKCQCSESTCIMNPEVVQSNGVKTFSSCSLRSFQNFISNVGVKCLQNKPQMQKKSPKPVCGNGRLEGNEICDCGTEAQCGPASCCDFRTCVLKDGAKCYKGLCCKDCQILQSGVECRPKAHPECDIAENCNGTSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENT

SEQ ID NO: 961 - protein, 672 aa, synthetic construct
  REGION 1..672: note = ADAM33 (Q9BZ11) ECD
VLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDT

SEQ ID NO: 962 - protein, 650 aa, synthetic construct
  REGION 1..650: note = ADAM7 (Q9H2U9) ECD
KFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKGIHDEKYVELFIVADDTVYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTN

SEQ ID NO: 963 - protein, 639 aa, synthetic construct
  REGION 1..639: note = ADAM8 (P78325) ECD
IAPSRPWALMEQYEVVLPWRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLP

SEQ ID NO: 964 - protein, 669 aa, synthetic construct
  REGION 1..669: note = ADAM9 (Q13443) ECD
AARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRD

SEQ ID NO: 965 - protein, 320 aa, synthetic construct
  REGION 1..320: note = AGER (Q15109) ECD
AQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLA

SEQ ID NO: 966 - protein, 500 aa, synthetic construct
  REGION 1..500: note = ALCAM (Q13740) ECD
WYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAK

SEQ ID NO: 967 - protein, 1020 aa, synthetic construct
  REGION 1..1020: note = ALK (Q9UM73) ECD
VGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILS

SEQ ID NO: 968 - protein, 132 aa, synthetic construct [sequence omitted]

SEQ ID NO: 969 - protein, 256 aa, synthetic construct
  REGION 1..256: note = AMICA1 (Q86YT9) ECD
LNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQL

SEQ ID NO: 970 - protein, 345 aa, synthetic construct
  REGION 1..345: note = AMIGO1 (Q86WK6) ECD
GRAVVSCPAACLCASNILSCSKQQLPNVPHSLPSYTALLDLSHNNLSRLRAEWTPTRLTQLHSLLLSHNHLNFISSEAFSPVPNLRYLDLSSNQLRTLDEFLFSDLQVLEVLLLYNNHIMAVDRCAFDDMAQLQKLYLSQNQISRFPLELVKEGAKLPKLTLLDLSSNKLKNLPLPDLQKLPAWIKNGLYLHNNPLNCDCELYQLFSHWQYRQLSSVMDFQEDLYCMNSKKLHNVFNLSFLNCGEYKERAWEAHLGDTLIIKCDTKQQGMTKVWVTPSNERVLDEVTNGTVSVSKDGSLLFQQVQVEDGGVYTCYAMGETFNETLSVELKVHNFTLHGHHDTLNT

SEQ ID NO: 971 - protein, 359 aa, synthetic construct
  REGION 1..359: note = AMIGO2 (Q86SJ2) ECD
VCPTACICATDIVSCTNKNLSKVPGNLFRLIKRLDLSYNRIGLLDSEWIPVSFAKLNTLILRHNNITSISTGSFSTTPNLKCLDLSSNKLKTVKNAVFQELKVLEVLLLYNNHISYLDPSAFGGLSQLQKLYLSGNFLTQFPMDLYVGRFKLAELMFLDVSYNRIPSMPMHHINLVPGKQLRGIYLHGNPFVCDCSLYSLLVFWYRRHFSSVMDFKNDYTCRLWSDSRHSRQVLLLQDSFMNCSDSIINGSFRALGFIHEAQVGERLMVHCDSKTGNANTDFIWVGPDNRLLEPDKEMENFYVFHNGSLVIESPRFEDAGVYSCIAMNKQRLLNETVDVTINVSNFTVSRSHAHEAFNT

SEQ ID NO: 972 - protein, 364 aa, synthetic construct
  REGION 1..364: note = AMIGO3 (Q86WK7) ECD
TPDSEGFPPRALHNCPYKCICAADLLSCTGLGLQDVPAELPAATADLDLSHNALQRLRPGWLAPLFQLRALHLDHNELDALGRGVFVNASGLRLLDLSSNTLRALGRHDLDGLGALEKLLLFNNRLVHLDEHAFHGLRALSHLYLGCNELASFSFDHLHGLSATHLLTLDLSSNRLGHISVPELAALPAFLKNGLYLHNNPLPCDCRLYHLLQRWHQRGLSAVRDFAREYVCLAFKVPASRVRFFQHSRVFENCSSAPALGLERPEEHLYALVGRSLRLYCNTSVPAMRIAWVSPQQELLRAPGSRDGSIAVLADGSLAIGNVQEQHAGLFVCLATGPRLHHNQTHEYNVSVHFPRPEPEAFNT

SEQ ID NO: 973 - protein, 338 aa, synthetic construct
  REGION 1..338: note = AMN (Q9BXJ7) ECD
VSKLWVPNTDFDVAANWSQNRTPCAGGAVEFPADKMVSVLVQEGHAVSDMLLPLDGELVLASGAGFGVSDVGSHLDCGAGEPAVFRDSDRFSWHDPHLWRSGDEAPGLFFVDAERVPCRHDDVFFPPSASFRVGLGPGASPVRVRSISALGRTFTRDEDLAVFLASRAGRLRFHGPGALSVGPEDCADPSGCVCGNAEAQPWICAALLQPLGGRCPQAACHSALRPQGQCCDLCGAVVLLTHGPAFDLERYRARILDTFLGLPQYHGLQVAVSKVPRSSRLREADTEIQVVLVENGPETGGAGRLARALLADVAENGEALGVLEATMRESGAHVWGSS

SEQ ID NO: 974 - protein, 289 aa, synthetic construct [sequence omitted]

SEQ ID NO: 975 - protein, 285 aa, synthetic construct
  REGION 1..285: note = ANTXR2 (P58335) ECD
QEQPSCRRAFDLYFVLDKSGSVANNWIEIYNFVQQLAERFVSPEMRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSILAQSCTEILELQPSSVCVGEEFQIVLSGRGFMLGSRNGSVLCTYTVNETYTTSVKPVSVQLNSMLCPAPILNKAGETLDVSVSFNGGKSVISGSLIVTATECSNG

SEQ ID NO: 976 - protein, 326 aa, synthetic construct
  REGION 1..326: note = ANTXRL (A6NF34) ECD
GSLRYHGPDWRIFHRLALGSRRAHHHHGPGWRQHWRQGQAGHRCQGSFDLYFILDKSGSVNNNWIDLYMWVEETVARFQSPNIRMCFITYSTDGQTVLPLTSDKNRIKNGLDQLQKIVPDGHTFMQAGFRKAIQQIESFNSGNKVPSMIIAMTDGELVAHAFQDTLREAQKARKLGANVYTLGVADYNLDQITAIADSPGHVFAVENGFKALRSTIDALTSKVCLDVTSVEPSSECVGEPYHVVIHGNGFQNLKKRDEVICRFIFNESTIIDEKPTSIDNNSMNCPGPKLEKPGEEYSIEVSLNKGKTFFKSNVSITSTTCGIFRN

SEQ ID NO: 977 - protein, 466 aa, synthetic construct
  REGION 1..466: note = APCDD1 (Q8J025) ECD
LLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRH

SEQ ID NO: 978 - protein, 542 aa, synthetic construct
  REGION 1..542: note = APLP1 (P51693) ECD
SLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSRE

SEQ ID NO: 979 - protein, 661 aa, synthetic construct
  REGION 1..661: note = APLP2 (Q06481) ECD
GYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMVIDETLDVKEMIFNAERVGGLEEERESVGPLREDFSLSS

SEQ ID NO: 980 - protein, 684 aa, synthetic construct
  REGION 1..684: note = APP (P05067) ECD
LEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGA

SEQ ID NO: 981 - protein, 179 aa, synthetic construct
  REGION 1..179: note = AREG (P15514) ECD
SGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSK

SEQ ID NO: 982 - protein, 169 aa, synthetic construct
  REGION 1..169: note = ATRAID (Q6UW56) ECD
LPEICTQCPGSVQNLSKVAFYCKTTRELMLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFS

SEQ ID NO: 983 - protein, 1196 aa, synthetic construct
  REGION 1..1196: note = ATRN (O75882) ECD
AAAAAAVSGSAAAEAKECDRPCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIACDRWSVLPRPDLHHDVNRFGHSAVLHNSTMYVFGGFNSLLLSDILVFTSEQCDAHRSEAACLAAGPGIRCVWNTGSSQCISWALATDEQEEKLKSECFSKRTLDHDRCDQHTDCYSCTANTNDCHWCNDHCVPRNHSCSEGQISIFRYENCPKDNPMYYCNKKTSCRSCALDQNCQWEPRNQECIALPENICGIGWHLVGNSCLKITTAKENYDNAKLFCRNHNALLASLTTQKKVEFVLKQLRIMQSSQSMSKLTLTPWVGLRKINVSYWCWEDMSPFTNSLLQWMPSEPSDAGFCGILSEPSTRGLKAATCINPLNGSVCERPANHSAKQCRTPCALRTACGDCTSGSSECMWCSNMKQCVDSNAYVASFPFGQCMEWYTMSTCPPENCSGYCTCSHCLEQPGCGWCTDPSNTGKGKCIEGSYKGPVKMPSQAPTGNFYPQPLLNSSMCLEDSRYNWSFIHCPACQCNGHSKCINQSICEKCENLTTGKHCETCISGFYGDPTNGGKCQPCKCNGHASLCNTNTGKCFCTTKGVKGDECQLCEVENRYQGNPLRGTCYYTLLIDYQFTFSLSQEDDRYYTAINFVATPDEQNRDLDMFINASKNFNLNITWAASFSAGTQAGEEMPVVSKTNIKEYKDSFSNEKFDFRNHPNITFFVYVSNFTWPIKIQIAFSQHSNFMDL

SEQ ID NO: 984 - protein, 1178 aa, synthetic construct
  REGION 1..1178: note = ATRNL1 (Q5VV63) ECD
LYAQVSQSKPCERTGSCFSGRCVNSTCLCDPGWVGDQCQHCQGRFKLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWVIGGYTFNYSSFQMVLNYNLESSIWNVGTPSRGPLQRYGHSLALYQENIFMYGGRIETNDGNVTDELWVFNIHSQSWSTKTPTVLGHGQQYAVEGHSAHIMELDSRDVVMIIIFGYSAIYGYTSSIQEYHISSNTWLVPETKGAIVQGGYGHTSVYDEITKSIYVHGGYKALPGNKYGLVDDLYKYEVNTKTWTILKESGFARYLHSAVLINGAMLIFGGNTHNDTSLSNGAKCFSADFLAYDIACDEWKILPKPNLHRDVNRFGHSAVVINGSMYIFGGFSSVLLNDILVYKPPNCKAFRDEELCKNAGPGIKCVWNKNHCESWESGNTNNILRAKCPPKTAASDDRCYRYADCASCTANTNGCQWCDDKKCISANSNCSMSVKNYTKCHVRNEQICNKLTSCKSCSLNLNCQWDQRQQECQALPAHLCGEGWSHIGDACLRVNSSRENYDNAKLYCYNLSGNLASLTTSKEVEFVLDEIQKYTQQKVSPWVGLRKINISYWGWEDMSPFTNTTLQWLPGEPNDSGFCAYLERAAVAGLKANPCTSMANGLVCEKPVVSPNQNARPCKKPCSLRTSCSNCTSNGMECMWCSSTKRCVDSNAYIISFPYGQCLEWQTATCSPQNCSGLRTCGQCLEQPGCGWCNDPSNTGRGHCIEGSSRGPMKLIGMHHSEMVLDTNLCPKEKNYEWSFIQCPACQCNGHSTCINNNVCEQCKNLTTGKQCQDCMPGYYGDPTNGGQCTACTCSGHANICHLHTGKCFCTTKGIKGDQCQLCDSENRYVGNPLRGTCYYSLLIDYQFTFSLLQEDDRHHTAINFIANPEQSNKNLDISINASNNFNLNITWSVGSTAGTISGEETSIVSKNNIKEYRDSFSYEKFNFRSNPNITFYVYVSNFSWPIKIQIAFSQHNTIMDL

SEQ ID NO: 985 - protein, 426 aa, synthetic construct
  REGION 1..426: note = AXL (P30530) ECD
APRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWW

SEQ ID NO: 986 - protein, 436 aa, synthetic construct
  REGION 1..436: note = BACE1 (P56817) ECD
TQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLVSIPHGPNVTVRANIAAITESDKFFINGSNWEGILGLAYAEIARPDDSLEPFFDSLVKQTHVPNLFSLQLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMT

SEQ ID NO: 987 - protein, 453 aa, synthetic construct
  REGION 1..453: note = BACE2 (Q9Y5Z0) ECD
APELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSY

SEQ ID NO: 988 - protein, 132 aa, synthetic construct
  REGION 1..132: note = BAMBI (Q13145) ECD
VLLTKGEIRCYCDAAHCVATGYMCKSELSACFSRLLDPQNSNSPLTHGCLDSLASTTDICQAKQARNHSGTTIPTLECCHEDMCNYRGLHDVLSPPRGEASGQGNRYQHDGSRNLITKVQELTSSKELWFRA

SEQ ID NO: 989 - protein, 516 aa, synthetic construct
  REGION 1..516: note = BCAM (P50895) ECD
EVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQA

SEQ ID NO: 990 - protein, 129 aa, synthetic construct
  REGION 1..129: note = BMPR1A (P36894) ECD
QNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIR

SEQ ID NO: 991 - protein, 124 aa, synthetic construct [sequence omitted]

SEQ ID NO: 992 - protein, 825 aa, synthetic construct
  REGION 1..825: note = BOC (Q9BWV1) ECD
DLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPY

SEQ ID NO: 993 - protein, 186 aa, synthetic construct
  REGION 1..186: note = BSG (P35613) ECD
EPGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLA

SEQ ID NO: 994 - protein, 87 aa, synthetic construct
  REGION 1..87: note = BTC (P35070) ECD
DGNSTRSPETNGLLCGDPEENCAATTTQSKRKGHFSRCPKQYKHYCIKGRCRFVVAEQTPSCVCDEGYIGARCERVDLFYLRGDRGQ

SEQ ID NO: 995 - protein, 127 aa, synthetic construct
  REGION 1..127: note = BTLA (Q7Z6A9) ECD
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYR

SEQ ID NO: 996 - protein, 216 aa, synthetic construct
  REGION 1..216: note = BTN1A1 (Q13410) ECD
APFDVIGPPEPILAVVGEDAELPCRLSPNASAEHLELRWFRKKVSPAVLVHRDGREQEAEQMPEYRGRATLVQDGIAKGRVALRIRGVRVSDDGEYTCFFREDGSYEEALVHLKVAALGSDPHISMQVQENGEICLECTSVGWYPEPQVQWRTSKGEKFPSTSESRNPDEEGLFTVAASVIIRDTSAKNVSCYIQNLLLGQEKKVEISIPASSLPR

SEQ ID NO: 997 - protein, 220 aa, synthetic construct
  REGION 1..220: note = BTN2A1 (Q7KYR7) ECD
QFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCA

SEQ ID NO: 998 - protein, 233 aa, synthetic construct
  REGION 1..233: note = BTN2A2 (Q8WVV5) ECD
QFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWM

SEQ ID NO: 999 - protein, 219 aa, synthetic construct
  REGION 1..219: note = BTN2A3P (Q96KV6) ECD
QVTVVGPTDPILAMVGENTTLRCCLSPEENAEDMEVRWFQSQFSPAVFVYKGGRERTEEQKEEYRGRTTFVSKDSRGSVALIIHNVTAEDNGIYQCYFQEGRSCNEAILHLVVAGLDSEPVIEMRDHEDGGIQLECISGGWYPKPLTVWRDPYGEVVPALKEVSTPDADSLFMVTTAVIIRDKSVRNVSCSINDTLLGQKKESVIFIPESFMPSRSPCV

SEQ ID NO: 1000 - protein, 225 aa, synthetic construct
  REGION 1..225: note = BTN3A1 (O00481) ECD
QFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAG

SEQ ID NO: 1001 - protein, 219 aa, synthetic construct
  REGION 1..219: note = BTN3A2 (P78410) ECD
QFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPW

SEQ ID NO: 1002 - protein, 219 aa, synthetic construct
  REGION 1..219: note = BTN3A3 (O00478) ECD
QFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPW

SEQ ID NO: 1003 - protein, 228 aa, synthetic construct
  REGION 1..228: note = BTNL10 (A8MVZ5) ECD
SIWKADFDVTGPHAPILAMAGGHVELQCQLFPNISAEDMELRWYRCQPSLAVHMHERGMDMDGEQKWQYRGRTTFMSDHVARGKAMVRSHRVTTFDNRTYCCRFKDGVKFGEATVQVQVAGLGREPRIQVTDQQDGVRAECTSAGCFPKSWVERRDFRGQARPAVTNLSASATTRLWAVASSLTLWDRAVEGLSCSISSPLLPERRKVAESHLPATFSRSSQFTAWKA

SEQ ID NO: 1004 - protein, 220 aa, synthetic construct
  REGION 1..220: note = BTNL3 (Q6UXE8) ECD
QWQVTGPGKFVQALVGEDAVFSCSLFPETSAEAMEVRFFRNQFHAVVHLYRDGEDWESKQMPQYRGRTEFVKDSIAGGRVSLRLKNITPSDIGLYGCWFSSQIYDEEATWELRVAALGSLPLISIVGYVDGGIQLLCLSSGWFPQPTAKWKGPQGQDLSSDSRANADGYSLYDVEISIIVQENAGSILCSIHLAEQSHEVESKVLIGETFFQPSPWRLAS

SEQ ID NO: 1005 - protein, 222 aa, synthetic construct
  REGION 1..222: note = BTNL9 (Q6UXG8) ECD
SSEVKVLGPEYPILALVGEEVEFPCHLWPQLDAQQMEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIADVFVPGASAWK

SEQ ID NO: 1006 - protein, 162 aa, synthetic construct
  REGION 1..162: note = C10orf54 (Q9H7M9) ECD
FKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAA

SEQ ID NO: 1007 - protein, 380 aa, synthetic construct
  REGION 1..380: note = C11orf24 (Q96F05) ECD
ASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKT

SEQ ID NO: 1008 - protein, 38 aa, synthetic construct
  REGION 1..38: note = C11orf87 (Q6NUJ2) ECD
SPNASGSGNTGARGPGAVGSGTCITQVGQQLFQSFSST

SEQ ID NO: 1009 - protein, 57 aa, synthetic construct
  REGION 1..57: note = C14orf132 (Q9NPU4) ECD
MDLSFMAAQLPMMGGAFMDSPNEDFSTEYSLFNSSANVHAAANGQGQPEDPPRSSND

SEQ ID NO: 1010 - protein, 687 aa, synthetic construct
  REGION 1..687: note = C14orf37 (Q86TY3) ECD
FPKIERRREIAHVHAEKGQSDKMNTDDLENSSVTSKQTPQLVVSEDPMMMSAVPSATSLNKAFSINKETQPGQAGLMQTERPGVSTPTESGVPSAEEVFGSSQPERISPESGLAKAMLTIAITATPSLTVDEKEELLTSTNFQPIVEEITETTKGFLKYMDNQSFATESQEGVGLGHSPSSYVNTKEMLTTNPKTEKFEADTDHRTTSFPGAESTAGSEPGSLTPDKEKPSQMTADNTQAAATKQPLETSEYTLSVEPETDSLLGAPEVTVSVSTAVPAASALSDEWDDTKLESVSRIRTPKLGDNEETQVRTEMSQTAQVSHEGMEGGQPWTEAAQVALGLPEGETHTGTALLIAHGNERSPAFTDQSSFTPTSLMEDMKVSIVNLLQSTGDFTESTKENDALFFLETTVSVSVYESEADQLLGNTMKDIITQEMTTAVQEPDATLSMVTQEQVATLELIRDSGKTEEEKEDPSPVSDVPGVTQLSRRWEPLATTISTTVVPLSFEVTPTVEEQMDTVTGPNEEFTPVLGSPVTPPGIMVGEPSISPALPALEASSERRTVVPSITRVNTAASYGLDQLESEEGQEDEDEEDEEDEDEEEEDEEEDEEDKDADSLDEGLDGDTELPGFTLPGITSQEPGLEEGNMDLLEGATYQVPDALEWEQQNQGLVRSWMEKLKDKAGYMSGM

SEQ ID NO: 1011 - protein, 71 aa, synthetic construct
  REGION 1..71: note = C19orf18 (Q8NEA5) ECD
LHPTGNITGLPGSKRSQPPRNITKEPKVFFHKTQLPGIQGAASRSTAASPTNPMKFLRNKAIIRHRPALVK

SEQ ID NO: 1012 - protein, 884 aa, synthetic construct
  REGION 1..884: note = C1orf101 (Q5SY80) ECD
LWRYSTNSPNYRIFSTRSTIKLEYEGTLFTEWSVPETCFVLNKSSPTTELRCSSPGVHAIKPIVTGPDEEERYLFVESSHTCFLWYYRVRHFFNNFTQLITVWAYDPESADPDELLGNAEEPSINSIVLSTQMATLGQKPVIHTVLKRKVYSSNEKMRRGTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILSRDGIVFLINGVLYIKSFRGFIRLGGIVNLPDGGITGISSRKWCWVNYLLKAKGRRSTFAVWTENEIYLGSILLKFARLVTTTELKNILSLSVTATLTIDRVEYTGHPLEIAVFLNYCTVCNVTKKIFLVIYNEDTKQWVSQDFTLDAPIDSVTMPHFTFSALPGLLLWNKHSIYYCYHNFTFTGILQTPAGHGNLSMLSNDSIIHEVFIDYYGDILVKMENNVIFYSKINTRDAVKLHLWTNYTTRAFIFLSTSGQTYFLYALDDGTIQIQDYPLHLEAQSIAFTTKDKCPYMAFHNNVAHVFYFLDKGEALTVWTQIVYPENTGLYVIVESYGPKILQESHEISFEAAFGYCTKTLTLTFYQNVDYERISDYFETQDKHTGLVLVQFRPSEYSKACPIAQKVFQIAVGCDDKKFIAIKGFSKKGCHHHDFSYVIEKSYLRHQPSKNLRVRYIWGEYGCPLRLDFTEKFQPVVQLFDDNGYVKDVEANFIVWEIHGRDDYSFNNTMAQSGCLHEAQTWKSMIELNKHLPLEEVWGPENYKHCFSYAIGKPGDLNQPYEIINSSNGNHIFWPMGHSGMYVFRVKILDPNYSFCNLTAMFAIETFGLIPSPS

SEQ ID NO: 1013 - protein, 129 aa, synthetic construct
  REGION 1..129: note = C1orf159 (Q96HA4) ECD
KSMENTVTRNSTAVINTQAEGTLSPPGLSSLPVVREWALTHTAQLPECCVDVVGVNASCPGASLCGPGCYRRWNADGSASCVRCGNGTLPAYNGSECRSFAGPGAPFPMNRSSGTPGRPHPGAPRVAAS

SEQ ID NO: 1014 - protein, 162 aa, synthetic construct
  REGION 1..162: note = C1orf233 (F2Z333) ECD
AAPTPPGWEPTPDAPWCPYKVLPEGPEAGGGRLCFRSPARGFRCQAPGCVLHAPAGRSLRASVLRNRSVLLQWRLAPAAARRVRAFALNCSWRGAYTRFPCERVLLGASCRDYLLPDVHDSVLYRLCLQPLPLRAGPAAAAPETPEPAECVEFTAEPAGMQD

SEQ ID NO: 1015 - protein, 337 aa, synthetic construct
  REGION 1..337: note = C1orf85 (Q8WWB7) ECD
EKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLG

SEQ ID NO: 1016 - protein, 46 aa, synthetic construct
  REGION 1..46: note = C3orf80 (F5H4A9) ECD
RGGGGCAELACGERERCCDATNATAVRCCKLPLHAFLDNVGWFVRK

SEQ ID NO: 1017 - protein, 277 aa, synthetic construct
  REGION 1..277: note = CA12 (O43570) ECD
APVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQVQVCTAAGLS

SEQ ID NO: 1018 - protein, 275 aa, synthetic construct
  REGION 1..275: note = CA14 (Q9ULX7) ECD
ADGGQHWTYEGPHGQDHWPASYPECGNNAQSPIDIQTDSVTFDPDLPALQPHGYDQPGTEPLDLHNNGHTVQLSLPSTLYLGGLPRKYVAAQLHLHWGQKGSPGGSEHQINSEATFAELHIVHYDSDSYDSLSEAAERPQGLAVLGILIEVGETKNIAYEHILSHLHEVRHKDQKTSVPPFNLRELLPKQLGQYFRYNGSLTTPPCYQSVLWTVFYRRSQISMEQLEKLQGTLFSTEEEPSKLLVQNYRALQPLNQRMVFASFIQAGSSYTTGEM

SEQ ID NO: 1019 - protein, 1060 aa, synthetic construct
  REGION 1..1060: note = CACHD1 (Q5VU97) ECD
EADFSILDEAQVLASQMRRLAAEELGVVTMQRIFNSFVYTEKISNGESEVQQLAKKIREKFNRYLDVVNRNKQVVEASYTAHLTSPLTAIQDCCTIPPSMMEFDGNFNTNVSRTISCDRLSTTVNSRAFNPGRDLNSVLADNLKSNPGIKWQYFSSEEGIFTVFPAHKFRCKGSYEHRSRPIYVSTVRPQSKHIVVILDHGASVTDTQLQIAKDAAQVILSAIDEHDKISVLTVADTVRTCSLDQCYKTFLSPATSETKRKMSTFVSSVKSSDSPTQHAVGFQKAFQLIRSTNNNTKFQANTDMVIIYLSAGITSKDSSEEDKKATLQVINEENSFLNNSVMILTYALMNDGVTGLKELAFLRDLAEQNSGKYGVPDRMALPVIKGSMMVLNQLSNLETTVGRFYTNLPNRMIDEAVFSLPFSDEMGDGLIMTVSKPCYFGNLLLGIVGVDVNLAYILEDVTYYQDSLASYTFLIDDKGYTLMHPSLTRPYLLSEPPLHTDIIHYENIPKFELVRQNILSLPLGSQIIAVPVNSSLSWHINKLRETGKEAYNVSYAWKMVQDTSFILCIVVIQPEIPVKQLKNLNTVPSSKLLYHRLDLLGQPSACLHFKQLATLESPTIMLSAGSFSSPYEHLSQPETKRMVEHYTAYLSDNTRLIANPGLKFSVRNEVMATSHVTDEWMTQMEMSSLNTYIVRRYIATPNGVLRIYPGSLMDKAFDPTRRQWYLHAVANPGLISLTGPYLDVGGAGYVVTISHTIHSSSTQLSSGHTVAVMGIDFTLRYFYKVLMDLLPVCNQDGGNKIRCFIMEDRGYLVAHPTLIDPKGHAPVEQQHITHKEPLVANDILNHPNFVKKNLCNSFSDRTVQRFYKFNTSLAGDLTNLVHGSHCSKYRLARIPGTNAFVGIVNETCDSLAFCACSMVDRLCLNCHRMEQNECECPCECPLEVNECTGNLTNAENRNPSCEVHQEPVTYTAIDPGLQDALHQCVNSRCSQRLESGDCFGVLDCEWCMVDSDGKTHLDKPYCAPQKECFGGIVGAKSPYVDDMGAIGDEVITLNMIKSAP

SEQ ID NO: 1020 - protein, 330 aa, synthetic construct
  REGION 1..330: note = CADM1 (Q9BY67) ECD
QNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDH

SEQ ID NO: 1021 - protein, 343 aa, synthetic construct
  REGION 1..343: note = CADM2 (Q8N3J6) ECD
QFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKDVKYLKEEDANRKTFTVSSTLDFRVDRSDDGVAVICRVDHESLNATPQVAMQVLEIHYTPSVKIIPSTPFPQEGQPLILTCESKGKPLPEPVLWTKDGGELPDPDRMVVSGRELNILFLNKTDNGTYRCEATNTIGQSSAEYVLIVHDVPNTLLPTTIIPSLTTATVTTTVAITTSPTTSATTSSIRDPNALAGQNGPDH

SEQ ID NO: 1022 - protein, 306 aa, synthetic construct
  REGION 1..306: note = CADM3 (Q8N126) ECD
NLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYH

SEQ ID NO: 1023 - protein, 304 aa, synthetic construct
  REGION 1..304: note = CADM4 (Q8NFZ8) ECD
PGAGQEVQTENVTVAEGGVAEITCRLHQYDGSIVVIQNPARQTLFFNGTRALKDERFQLEEFSPRRVRIRLSDARLEDEGGYFCQLYTEDTHHQIATLTVLVAPENPVVEVREQAVEGGEVELSCLVPRSRPAATLRWYRDRKELKGVSSSQENGKVWSVASTVRFRVDRKDDGGIIICEAQNQALPSGHSKQTQYVLDVQYSPTARIHASQAVVREGDTLVLTCAVTGNPRPNQIRWNRGNESLPERAEAVGETLTLPGLVSADNGTYTCEASNKHGHARALYVLVVYDPGAVVEAQTSVPYA

SEQ ID NO: 1024 - protein, 698 aa, synthetic construct
  REGION 1..698: note = CATSPERD (Q86XM0) ECD
QLCRSRTVRTGKVFNLIQDVQGDRLYFHPTTTRLIKHPCEKNIALYLGKQVFFTMDNFETSLLPFTIPTSMQVGVPEVTSAHFAGSLLLLVVDQKVYIYDYENNSWSMSLGIKHPVTHVSGDNCCYTGSLFCVHVSNLVFAYFRGDQISQTYIYYSNTGGFSFWKYHYDRQAEIIGSLGGIFHFFSLSQVAMLVVNQGKGMFKYSDHPLNRSFGLSFDYNGTLDILIAPGQRGILLLWFENSLLFSHNAGQLVDTVRVKKGDQTLFSSIFEAKITIHNIAVTENELAVITREDNLYYGNLGIVPSSIIKFADQYIWSEDVALMFRSPGTLEILTPLRDTAFPAFDFQKCLVNIQALLMDPELHVGKCKIEFLTGEFIYRMYTIDMHSQLELTASLIPQPGTSLIPLVMVSNPHSLGFQATFYENGYTSDGNTKYKLDIFLKQQQHWGRTDSNFTSSLKKATMSTLTVDIANKEISCVDIKPLSTLISVGCDLDKKIVIQNKVSACSMGILDPLTLQDNYSFIIEKEFYDPGFQGQQSSEDLHVFYSYQQLGCPLLVYYDTLWKPVVELWRKDSFQEVIDAEYVLLEVNGQFSYSYSLTAQSAMCTSQPQNWTTMIKEFGGPFFWNRENYVSCHDPNNNAPLRWPDVQYQILGGRTANQIIFGHNGFYVFYISIVDPYYSYCQLETIFSIYVYGAFPVQ

SEQ ID NO: 1025 - protein, 1031 aa, synthetic construct
  REGION 1..1031: note = CATSPERG (Q6ZRH7) ECD
WAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKPYADPVHDPTWRWWANNKQDQDYYFFLASNWRSAGGVSIEMDSYEKIYNLESAYELPERIFLDKGTEYSFAIFLSAQGHSFRTQSELGTAFQLHSQVDVGVVLADPGCIEASVKQEVLINRNSVLFSITLKDKKLCYDQGISGHHLMETSMTVNVVGSSGLCFQETHLGPHMQGNLMVPVFIGCPPGKRLAFDITYTLEYSRLKNKHYFDCVNVNPEMPCFLFRDIFYPFFLIQDLVTGDSGSFQGSYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNRGVDTSTYCNYQLTFLLHIHGLPLSPKRA

SEQ ID NO: 1026 - protein, 934 aa, synthetic construct
  REGION 1..934: note = CD101 (Q93033) ECD
QREVTVQKGPLFRAEGYPVSIGCNVTGHQGPSEQHFQWSVYLPTNPTQEVQIISTKDAAFSYAVYTQRVRSGDVYVERVQGNSVLLHISKLQMKDAGEYECHTPNTDEKYYGSYSAKTNLIVIPDTLSATMSSQTLGKEEGEPLALTCEASKATAQHTHLSVTWYLTQDGGGSQATEIISLSKDFILVPGPLYTERFAASDVQLNKLGPTTFRLSIERLQSSDQGQLFCEATEWIQDPDETWMFITKKQTDQTTLRIQPAVKDFQVNITADSLFAEGKPLELVCLVVSSGRDPQLQGIWFFNGTEIAHIDAGGVLGLKNDYKERASQGELQVSKLGPKAFSLKIFSLGPEDEGAYRCVVAEVMKTRTGSWQVLQRKQSPDSHVHLRKPAARSVVMSTKNKQQVVWEGETLAFLCKAGGAESPLSVSWWHIPRDQTQPEFVAGMGQDGIVQLGASYGVPSYHGNTRLEKMDWATFQLEITFTAITDSGTYECRVSEKSRNQARDLSWTQKISVTVKSLESSLQVSLMSRQPQVMLTNTFDLSCVVRAGYSDLKVPLTVTWQFQPASSHIFHQLIRITHNGTIEWGNFLSRFQKKTKVSQSLFRSQLLVHDATEEETGVYQCEVEVYDRNSLYNNRPPRASAISHPLRIAVTLPESKLKVNSRSQVQELSINSNTDIECSILSRSNGNLQLAIIWYFSPVSTNASWLKILEMDQTNVIKTGDEFHTPQRKQKFHTEKVSQDLFQLHILNVEDSDRGKYHCAVEEWLLSTNGTWHKLGEKKSGLTELKLKPTGSKVRVSKVYWTENVTEHREVAIRCSLESVGSSATLYSVMWYWNRENSGSKLLVHLQHDGLLEYGEEGLRRHLHCYRSSSTDFVLKLHQVEMEDAGMYWCRVAEWQLHGHPSKWINQASDESQRMVLTVLPSEPTLPSRICSSAP

SEQ ID NO: 1027 - protein, 1009 aa, synthetic construct
  REGION 1..1009: note = CD163 (Q86VB7) ECD
SSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSS

SEQ ID NO: 1028 - protein, 1319 aa, synthetic construct
  REGION 1..1319: note = CD163L1 (Q9NR16) ECD
FNGTDLELRLVNGDGPCSGTVEVKFQGQWGTVCDDGWNTTASTVVCKQLGCPFSFAMFRFGQAVTRHGKIWLDDVSCYGNESALWECQHREWGSHNCYHGEDVGVNCYGEANLGLRLVDGNNSCSGRVEVKFQERWGTICDDGWNLNTAAVVCRQLGCPSSFISSGVVNSPAVLRPIWLDDILCQGNELALWNCRHRGWGNHDCSHNEDVTLTCYDSSDLELRLVGGTNRCMGRVELKIQGRWGTVCHHKWNNAAADVVCKQLGCGTALHFAGLPHLQSGSDVVWLDGVSCSGNESFLWDCRHSGTVNFDCLHQNDVSVICSDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSDKADLDLRLVGAHSPCYGRLEVKYQGEWGTVCHDRWSTRNAAVVCKQLGCGKPLHVFGMTYFKEASGPIWLDDVSCIGNESNIWDCEHSGWGKHNCVHREDVIVTCSGDATWGLRLVGGSNRCSGRLEVYFQGRWGTVCDDGWNSKAAAVVCSQLDCPSSIIGMGLGNASTGYGKIWLDDVSCDGDESDLWSCRNSGWGNNDCSHSEDVGVICSDASDMELRLVGGSSRCAGKVEVNVQGAVGILCANGWGMNIAEVVCRQLECGSAIRVSREPHFTERTLHILMSNSGCTGGEASLWDCIRWEWKQTACHLNMEASLICSAHRQPRLVGADMPCSGRVEVKHADTWRSVCDSDFSLHAANVLCRELNCGDAISLSVGDHFGKGNGLTWAEKFQCEGSETHLALCPIVQHPEDTCIHSREVGVVCSRYTDVRLVNGKSQCDGQVEINVLGHWGSLCDTHWDPEDARVLCRQLSCGTALSTTGGKYIGERSVRVWGHRFHCLGNESLLDNCQMTVLGAPPCIHGNTVSVICTGSLTQPLFPCLANVSDPYLSAVPEGSALICLEDKRLRLVDGDSRCAGRVEIYHDGFWGTICDDGWDLSDAHVVCQKLGCGVAFNATVSAHFGEGSGPIWLDDLNCTGMESHLWQCPSRGWGQHDCRHKEDAGVICSEFTALRLYSETETESCAGRLEVFYNGTWGSVGRRNITTAIAGIVCRQLGCGENGVVSLAPLSKTGSGFMWVDDIQCPKTHISIWQCLSAPWERRISSPAEETWITCEDRIRVRGGDTECSGRVEIWHAGSWGTVCDDSWDLAEAEVVCQQLGCGSALAALRDASFGQGTGTIWLDDMRCKGNESFLWDCHAKPWGQSDCGHKEDAGVRCSGQSLKSLNASSGH

SEQ ID NO: 1029 - protein, 139 aa, synthetic construct
  REGION 1..139: note = CD164 (Q04900) ECD
DKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFD

SEQ ID NO: 1030 - protein, 112 aa, synthetic construct
  REGION 1..112: note = CD164L2 (Q6UWJ8) ECD
GKGARGFGRGALIRLNIWPAVQGACKQLEVCEHCVEGDGARNLSSCVWEQCRPEEPGHCVAQSEVVKEGCSIYNRSEACPAAHHHPTYEPKTVTTGSPPVPEAHSPGFDGAS

SEQ ID NO: 1031 - protein, 603 aa, synthetic construct [sequence omitted]

SEQ ID NO: 1032 - protein, 272 aa, synthetic construct
  REGION 1..272: note = CD19 (P15391) ECD
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWK

SEQ ID NO: 1033 - protein, 284 aa, synthetic construct
  REGION 1..284: note = CD1A (P06126) ECD
NADGLKEPLSFHVTWIASFYNHSWKQNLVSGWLSDLQTHTWDSNSSTIVFLCPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWEHHSSV

SEQ ID NO: 1034 - protein, 286 aa, synthetic construct
  REGION 1..286: note = CD1B (P29016) ECD
SEHAFQGPTSFHVIQTSSFTNSTWAQTQGSGWLDDLQIHGWDSDSGTAIFLKPWSKGNFSDKEVAELEEIFRVYIFGFAREVQDFAGDFQMKYPFEIQGIAGCELHSGGAIVSFLRGALGGLDFLSVKNASCVPSPEGGSRAQKFCALIIQYQGIMETVRILLYETCPRYLLGVLNAGKADLQRQVKPEAWLSSGPSPGPGRLQLVCHVSGFYPKPVWVMWMRGEQEQQGTQLGDILPNANWTWYLRATLDVADGEAAGLSCRVKHSSLEGQDIILYWRNPTSIGS

SEQ ID NO: 1035 - protein, 285 aa, synthetic construct
  REGION 1..285: note = CD1C (P29017) ECD
NADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWGHHFSM

SEQ ID NO: 1036 - protein, 282 aa, synthetic construct
  REGION 1..282: note = CD1D (P15813) ECD
EVPQRLFPLRCLQISSFANSSWTRTDGLAWLGELQTHSWSNDSDTVRSLKPWSQGTFSDQQWETLQHIFRVYRSSFTRDVKEFAKMLRLSYPLELQVSAGCEVHPGNASNNFFHVAFQGKDILSFQGTSWEPTQEAPLWVNLAIQVLNQDKWTRETVQWLLNGTCPQFVSGLLESGKSELKKQVKPKAWLSRGPSPGPGRLLLVCHVSGFYPKPVWVKWMRGEQEQQGTQPGDILPNADETWYLRATLDVVAGEAAGLSCRVKHSSLEGQDIVLYWGGSYTS

SEQ ID NO: 1037 - protein, 285 aa, synthetic construct
  REGION 1..285: note = CD1E (P15812) ECD
APQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGY

SEQ ID NO: 1038 - protein, 185 aa, synthetic construct
  REGION 1..185: note = CD2 (P06729) ECD
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD

SEQ ID NO: 1039 - protein, 202 aa, synthetic construct
  REGION 1..202: note = CD200 (P41217) ECD
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKG

SEQ ID NO: 1040 - protein, 215 aa, synthetic construct
  REGION 1..215: note = CD200R1 (Q8TD46) ECD
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKL

SEQ ID NO: 1041 - protein, 216 aa, synthetic construct
  REGION 1..216: note = CD200R1L (Q6Q8B3) ECD
GKQMTQNYSTIFAEGNISQPVLMDINAVLCCPPIALRNLIIITWEIILRGQPSCTKAYKKETNETKETNCTVERITWVSRPDQNSDLQIRPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLL

SEQ ID NO: 1042 - protein, 668 aa, synthetic construct
  REGION 1..668: note = CD22 (P20273) ECD
DSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRR

SEQ ID NO: 1043 - protein, 236 aa, synthetic construct [sequence omitted]

SEQ ID NO: 1044 - protein, 208 aa, synthetic construct
  REGION 1..208: note = CD244 (Q9BZW8) ECD
CQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFESLLPDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWP

SEQ ID NO: 1045 - protein, 670 aa, synthetic construct
  REGION 1..670: note = CD248 (Q9HCU0) ECD
QDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRWL

SEQ ID NO: 1046 - protein, 172 aa, synthetic construct
  REGION 1..172: note = CD27 (P26842) ECD
ATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIR

SEQ ID NO: 1047 - protein, 220 aa, synthetic construct
  REGION 1..220: note = CD274 (Q9NZQ7) ECD
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1048 - protein, 438 aa, synthetic construct
  REGION 1..438: note = CD276 (Q5ZPR3) ECD
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEA

SEQ ID NO: 1049 - protein, 134 aa, synthetic construct
  REGION 1..134: note = CD28 (P10747) ECD
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 1050 - protein, 163 aa, synthetic construct [sequence omitted]

SEQ ID NO: 1051 - protein, 163 aa, synthetic construct
  REGION 1..163: note = CD300C (Q08708) ECD
GYFPLSHPMTVAGPVGGSLSVQCRYEKEHRTLNKFWCRPPQILRCDKIVETKGSAGKRNGRVSIRDSPANLSFTVTLENLTEEDAGTYWCGVDTPWLRDFHDPIVEVEVSVFPAGTTTASSPQSSMGTSGPPTKLPVHTWPSVTRKDSPEPSPHPGSLFSNVR

SEQ ID NO: 1052 - protein, 156 aa, synthetic construct
  REGION 1..156: note = CD300E (Q496F6) ECD
LKGPGSVTGTAGDSLTVWCQYESMYKGYNKYWCRGQYDTSCESIVETKGEEKVERNGRVSIRDHPEALAFTVTMQNLNEDDAGSYWCKIQTVWVLDSWSRDPSDLVRVYVSPAITTPRRTTHPATPPIFLVVNPGRNLSTGEVLTQNSGFRLSSPH

SEQ ID NO: 1053 - protein, 147 aa, synthetic construct
  REGION 1..147: note = CD300LD (Q6UXZ3) ECD
AKITGPTTVNGSEQGSLTVQCAYGSGWETYLKWRCQGADWNYCNILVKTNGSEQEVKKNRVSIRDNQKNHVFTVTMENLKRDDADSYWCGTERPGIDLGVKVQVTINPGTQTAVSEWTTTTASLAFTAAATQKTSSPLTRSPLKSTH

SEQ ID NO: 1054 - protein, 137 aa, synthetic construct
  REGION 1..137: note = CD300LF (Q8TDQ1) ECD
TQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRHKLLKLS

SEQ ID NO: 1055 - protein, 229 aa, synthetic construct
  REGION 1..229: note = CD300LG (Q6UXG3) ECD
LEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGPCCPPSPSPTFQPLATTRLQPKAKAQQTQPPGLTSPGLYPAATTAKQGKTGAEAPPLPGTSQYGHERTSQYTGTSPHPATSPPAGSSRPPMQLDSTSAEDTSPALSSGSSKPRVSIPMVR

SEQ ID NO: 1056 - protein, 146 aa, synthetic construct
  REGION 1..146: note = CD302 (Q8IX05) ECD
DCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNH

SEQ ID NO: 1057 - protein, 194 aa, synthetic construct
  REGION 1..194: note = CD320 (Q9NPF0) ECD
SPLSTPTSAQAAGPSSGSCPPTKFQCRTSGLCVPLTWRCDRDLDCSDGSDEEECRIEPCTQKGQCPPPPGLPCPCTGVSDCSGGTDKKLRNCSRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAY

SEQ ID NO: 1058 - protein, 242 aa, synthetic construct
  REGION 1..242: note = CD33 (P20138) ECD
DPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVH

SEQ ID NO: 1059 - protein, 259 aa, synthetic construct
  REGION 1..259: note = CD34 (P28906) ECD
SLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKT

SEQ ID NO: 1060 - protein, 84 aa, synthetic construct [sequence omitted]

SEQ ID NO: 1061 - protein, 94 aa, synthetic construct
  REGION 1..94: note = CD3G (P09693) ECD
QSIKGNHLVKVYDYQEDGSVLLTCDAEAKNITWFKDGKMIGFLTEDKKKWNLGSNAKDPRGMYQCKGSQNKSKPLQVYYRMCQNCIELNAATIS

SEQ ID NO: 1062 - protein, 371 aa, synthetic construct
  REGION 1..371: note = CD4 (P01730) ECD
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 1063 - protein, 173 aa, synthetic construct
  REGION 1..173: note = CD40 (P25942) ECD
EPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLR

SEQ ID NO: 1064 - protein, 629 aa, synthetic construct
  REGION 1..629: note = CD44 (P16070) ECD
QIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPE

SEQ ID NO: 1065 - protein, 309 aa, synthetic construct
  REGION 1..309: note = CD46 (P15529) ECD
CEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLD

SEQ ID NO: 1066 - protein, 348 aa, synthetic construct
  REGION 1..348: note = CD5 (P06127) ECD
RLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNP

SEQ ID NO: 1067 - protein, 187 aa, synthetic construct
  REGION 1..187: note = CD58 (P19256) ECD
FSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHR

SEQ ID NO: 1068 - protein, 385 aa, synthetic construct
  REGION 1..385: note = CD6 (P30203) ECD
HPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLL

SEQ ID NO: 1069 - protein, 298 aa, synthetic construct
  REGION 1..298: note = CD68 (P34810) ECD
NDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRS

SEQ ID NO: 1070 - protein, 155 aa, synthetic construct
  REGION 1..155: note = CD7 (P09564) ECD
AQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALP

SEQ ID NO: 1071 - protein, 111 aa, synthetic construct
  REGION 1..111: note = CD79A (P11912) ECD
LWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNR

SEQ ID NO: 1072 - protein, 131 aa, synthetic construct
  REGION 1..131: note = CD79B (P40259) ECD
ARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKD

SEQ ID NO: 1073 - protein, 208 aa, synthetic construct [sequence omitted]

SEQ ID NO: 1074 - protein, 125 aa, synthetic construct
  REGION 1..125: note = CD83 (Q01151) ECD
TPEVKVACSEDVDLPCTAPWDPQVPYTVSWVKLLEGGEERMETPQEDHLRGQHYHQKGQNGSFDAPNERPYSLKIRNTTSCNSGTYRCTLQDPDGQRNLSGKVILRVTGCPAQRKEETFKKYRAE

SEQ ID NO: 1075 - protein, 204 aa, synthetic construct
  REGION 1..204: note = CD84 (Q9UIB8) ECD
KDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTG

SEQ ID NO: 1076 - protein, 224 aa, synthetic construct
  REGION 1..224: note = CD86 (P42081) ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1077 - protein, 161 aa, synthetic construct
  REGION 1..161: note = CD8A (P01732) ECD
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACD

SEQ ID NO: 1078 - protein, 149 aa, synthetic construct
  REGION 1..149: note = CD8B (P10966) ECD
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSP

SEQ ID NO: 1079 - protein, 152 aa, synthetic construct
  REGION 1..152: note = CD8BP (A6NJW9) ECD
NSVLQQTPAYIKVQTNKMVMLSCEAKISLSNMCIYWLRQRQAPSSDSHHEFLTLWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSP

SEQ ID NO: 1080 - protein, 557 aa, synthetic construct
  REGION 1..557: note = CD93 (Q9NPY3) ECD
ADTEAVVCVGTACYTAHSGKLSAAEAQNHCNQNGGNLATVKSKEEAQHVQRVLAQLLRREAALTARMSKFWIGLQREKGKCLDPSLPLKGFSWVGGGEDTPYSNWHKELRNSCISKRCVSLLLDLSQPLLPSRLPKWSEGPCGSPGSPGSNIEGFVCKFSFKGMCRPLALGGPGQVTYTTPFQTTSSSLEAVPFASAANVACGEGDKDETQSHYFLCKEKAPDVFDWGSSGPLCVSPKYGCNFNNGGCHQDCFEGGDGSFLCGCRPGFRLLDDLVTCASRNPCSSSPCRGGATCVLGPHGKNYTCRCPQGYQLDSSQLDCVDVDECQDSPCAQECVNTPGGFRCECWVGYEPGGPGEGACQDVDECALGRSPCAQGCTNTDGSFHCSCEEGYVLAGEDGTQCQDVDECVGPGGPLCDSLCFNTQGSFHCGCLPGWVLAPNGVSCTMGPVSLGPPSGPPDEEDKGEKEGSTVPRAATASPTRGPEGTPKATPTTSRPSLSSDAPITSAPLKMLAPSGSPGVWREPSIHHATAASGPQEPAGGDSSVATQNNDGTDGQK

SEQ ID NO: 1081 - protein, 498 aa, synthetic construct
  REGION 1..498: note = CD96 (P40200) ECD
VWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVENSSTDSWVLLSKGIKEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGM

SEQ ID NO: 1082 - protein, 638 aa, synthetic construct
  REGION 1..638: note = CDCP1 (Q9H5V8) ECD
FEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESNKIYVVDLSNERAMSLTIEPRPVKQSRKFVPGCFVCLESRTCSSNLTLTSGSKHKISFLCDDLTRLWMNVEKTISCTDHRYCQRKSYSLQVPSDILHLPVELHDFSWKLLVPKDRLSLVLVPAQKLQQHTHEKPCNTSFSYLVASAIPSQDLYFGSFCPGGSIKQIQVKQNISVTLRTFAPSFQQEASRQGLTVSFIPYFKEEGVFTVTPDTKSKVYLRTPNWDRGLPSLTSVSWNISVPRDQVACLTFFKERSGVVCQTGRAFMIIQEQRTRAEEIFSLDEDVLPKPSFHHHSFWVNISNCSPTSGKQLDLLFSVTLTPRTVDLT

SEQ ID NO: 1083 - protein, 555 aa, synthetic construct
  REGION 1..555: note = CDH1 (P12830) ECD
DWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPA

SEQ ID NO: 1084 - protein, 559 aa, synthetic construct
  REGION 1..559: note = CDH10 (Q9Y6N8) ECD
GWMWNQFFLLEEYTGSDYQYVGKLHSDQDKGDGSLKYILSGDGAGTLFIIDEKTGDIHATRRIDREEKAFYTLRAQAINRRTLRPVEPESEFVIKIHDINDNEPTFPEEIYTASVPEMSVVGTSVVQVTATDADDPSYGNSARVIYSILQGQPYFSVEPETGIIRTALPNMNRENREQYQVVIQAKDMGGQMGGLSGTTTVNITLTDVNDNPPRFPQNTIHLRVLESSPVGTAIGSVKATDADTGKNAEVEYRIIDGDGTDMFDIVTEKDTQEGIITVKKPLDYESRRLYTLKVEAENTHVDPRFYYLGPFKDTTIVKISIEDVDEPPVFSRSSYLFEVHEDIEVGTIIGTVMARDPDSISSPIRFSLDRHTDLDRIFNIHSGNGSLYTSKPLDRELSQWHNLTVIAAEINNPKETTRVAVFVRILDVNDNAPQFAVFYDTFVCENARPGQLIQTISAVDKDDPLGGQKFFFSLAAVNPNFTVQDNEDNTARILTRKNGFNRHEISTYLLPVVISDNDYPIQSSTGTLTIRVCACDSQGNMQSCSAEALLLPAGLSTGA

SEQ ID NO: 1085 - protein, 564 aa, synthetic construct
  REGION 1..564: note = CDH11 (P55287) ECD
GWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLST

SEQ ID NO: 1086 - protein, 555 aa, synthetic construct
  REGION 1..555: note = CDH12 (P55289) ECD
GWVWNQFFVLEEYVGSEPQYVGKLHSDLDKGEGTVKYTLSGDGAGTVFTIDETTGDIHAIRSLDREEKPFYTLRAQAVDIETRKPLEPESEFIIKVQDINDNEPKFLDGPYVATVPEMSPVGAYVLQVKATDADDPTYGNSARVVYSILQGQPYFSIDPKTGVIRTALPNMDREVKEQYQVLIQAKDMGGQLGGLAGTTIVNITLTDVNDNPPRFPKSIFHLKVPESSPIGSAIGRIRAVDPDFGQNAEIEYNIVPGDGGNLFDIVTDEDTQEGVIKLKKPLDFETKKAYTFKVEASNLHLDHRFHSAGPFKDTATVKISVLDVDEPPVFSKPLYTMEVYEDTPVGTIIGAVTAQDLDVGSSAVRYFIDWKSDGDSYFTIDGNEGTIATNELLDRESTAQYNFSIIASKVSNPLLTSKVNILINVLDVNEFPPEISVPYETAVCENAKPGQIIQIVSAADRDLSPAGQQFSFRLSPEAAIKPNFTVRDFRNNTAGIETRRNGYSRRQQELYFLPVVIEDSSYPVQSSTNTMTIRVCRCDSDGTILSCNVEAIFLP

SEQ ID NO: 1087 - protein, 546 aa, synthetic construct
  REGION 1..546: note = CDH15 (P55291) ECD
LPYPLVQIKSDKQQLGSVIYSIQGPGVDEEPRGVFSIDKFTGKVFLNAMLDREKTDRFRLRAFALDLGGSTLEDPTDLEIVVVDQNDNRPAFLQEAFTGRVLEGAVPGTYVTRAEATDADDPETDNAALRFSILQQGSPELFSIDELTGEIRTVQVGLDREVVAVYNLTLQVADMSGDGLTATASAIITLDDINDNAPEFTRDEFFMEAIEAVSGVDVGRLEVEDRDLPGSPNWVARFTILEGDPDGQFTIRTDPKTNEGVLSIVKALDYESCEHYELKVSVQNEAPLQAAALRAERGQAKVRVHVQDTNEPPVFQENPLRTSLAEGAPPGTLVATFSARDPDTEQLQRLSYSKDYDPEDWLQVDAATGRIQTQHVLSPASPFLKGGWYRAIVLAQDDASQPRTATGTLSIEILEVNDHAPVLAPPPPGSLCSEPHQGPGLLLGATDEDLPPHGAPFHFQLSPRLPELGRNWSLSQVNVSHARLRPRHQVPEGLHRLSLLLRDSGQPPQQREQPLNVTVCRCGKDGVCLPGAAALLAGGTGLSLGA

SEQ ID NO: 1088 - protein, 768 aa, synthetic construct
  REGION 1..768: note = CDH16 (O75309) ECD
KAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSA

SEQ ID NO: 1089 - protein, 765 aa, synthetic construct
  REGION 1..765: note = CDH17 (Q12864) ECD
QEGKFSGPLKPMTFSIYEGQEPSQIIFQFKANPPAVTFELTGETDNIFVIEREGLLYYNRALDRETRSTHNLQVAALDANGIIVEGPVPITIKVKDINDNRPTFLQSKYEGSVRQNSRPGKPFLYVNATDLDDPATPNGQLYYQIVIQLPMINNVMYFQINNKTGAISLTREGSQELNPAKNPSYNLVISVKDMGGQSENSFSDTTSVDIIVTENIWKAPKPVEMVENSTDPHPIKITQVRWNDPGAQYSLVDKEKLPRFPFSIDQEGDIYVTQPLDREEKDAYVFYAVAKDEYGKPLSYPLEIHVKVKDINDNPPTCPSPVTVFEVQENERLGNSIGTLTAHDRDEENTANSFLNYRIVEQTPKLPMDGLFLIQTYAGMLQLAKQSLKKQDTPQYNLTIEVSDKDFKTLCFVQINVIDINDQIPIFEKSDYGNLTLAEDTNIGSTILTIQATDADEPFTGSSKILYHIIKGDSEGRLGVDTDPHTNTGYVIIKKPLDFETAAVSNIVFKAENPEPLVFGVKYNASSFAKFTLIVTDVNEAPQFSQHVFQAKVSEDVAIGTKVGNVTAKDPEGLDISYSLRGDTRGWLKIDHVTGEIFSVAPLDREAGSPYRVQVVATEVGGSSLSSVSEFHLILMDVNDNPPRLAKDYTGLFFCHPLSAPGSLIFEATDDDQHLFRGPHFTFSLGSGSLQNDWEVSKINGTHARLSTRHTEFEEREYVVLIRINDGGRPPLEGIVSLPVTFCSCVEGSCFRPAGHQTGIPTVGM

SEQ ID NO: 1090 - protein, 555 aa, synthetic construct
  REGION 1..555: note = CDH18 (Q13634) ECD
GWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEDNTASILTRRRRFSRTVQDVYYLPIMISDGGIPSLSSSSTLTIRVCACERDGRVRTCHAEAFLSS

SEQ ID NO: 1091 - protein, 553 aa, synthetic construct
  REGION 1..553: note = CDH19 (Q9H159) ECD
GWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTE

SEQ ID NO: 1092 - protein, 565 aa, synthetic construct
  REGION 1..565: note = CDH2 (P19022) ECD
DWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGA

SEQ ID NO: 1093 - protein, 560 aa, synthetic construct
  REGION 1..560: note = CDH20 (Q9HBT6) ECD
SWVWNQFFVLEEYTGTDPLYVGKLHSDMDRGDGSIKYILSGEGAGIVFTIDDTTGDIHAIQRLDREERAQYTLRAQALDRRTGRPMEPESEFIIKIQDINDNEPKFLDGPYVATVPEMSPVGTSVIQVTATDADDPTYGNSARVVYSILQGQPYFSVDSKTGVIRTALMNMDREAKEYYEVIIQAKDMGGQLGGLAGTTTVNITLSDVNDNPPRFPQKHYQMSVLESAPISSTVGRVFAKDLDEGINAEMKYTIVDGDGADAFDISTDPNFQVGIITVKKPLSFESKKSYTLKVEGANPHLEMRFLNLGPFQDTTTVHISVEDVDEPPVFEPGFYFVEVPEDVAIGTTIQIISAKDPDVTNNSIRYSIDRSSDPGRFFYVDITTGALMTARPLDREEFSWHNITVLAMEMNNPSQVGSVPVTIKVLDVNDNAPEFPRFYEAFVCENAKAGQLIQTVSAVDQDDPRNGQHFYYSLAPEAANNPNFTIRDNQDNTARILTRRSGFRQQEQSVFHLPILIADSGQPVLSSTGTLTIQVCSCDDDGHVMSCSPEAYMLPVSLSR

SEQ ID NO: 1094 - protein, 589 aa, synthetic construct
  REGION 1..589: note = CDH22 (Q9UJ99) ECD
LWAAGTPSPSAPGARQDGALGAGRVKRGWVWNQFFVVEEYTGTEPLYVGKIHSDSDEGDGAIKYTISGEGAGTIFLIDELTGDIHAMERLDREQKTFYTLRAQARDRATNRLLEPESEFIIKVQDINDSEPRFLHGPYIGSVAELSPTGTSVMQVMASDADDPTYGSSARLVYSVLDGEHHFTVDPKTGVIRTAVPDLDRESQERYEVVIQATDMAGQLGGLSGSTTVTIVVTDVNDNPPRFPQKMYQFSIQESAPIGTAVGRVKAEDSDVGENTDMTYHLKDESSSGGDVFKVTTDSDTQEAIIVVQKRLDFESQPVHTVILEALNKFVDPRFADLGTFRDQAIVRVAVTDVDEPPEFRPPSGLLEVQEDAQVGSLVGVVTARDPDAANRPVRYAIDRESDLDQIFDIDADTGAIVTGKGLDRETAGWHNITVLAMEADNHAQLSRASLRIRILDVNDNPPELATPYEAAVCEDAKPGQLIQTISVVDRDEPQGGHRFYFRLVPEAPSNPHFSLLDIQDNTAAVHTQHVGFNRQEQDVFFLPILVVDSGPPTLSSTGTLTIRICGCDSSGTIQSCNTTAFVMAASLSP

SEQ ID NO: 1095 - protein, 3041 aa, synthetic construct
  REGION 1..3041: note = CDH23 (Q9H251) ECD
QVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVKVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSA

SEQ ID NO: 1096 - protein, 597 aa, synthetic construct
  REGION 1..597: note = CDH24 (Q86UP0) ECD
SWVWNQFFVIEEYAGPEPVLIGKLHSDVDRGEGRTKYLLTGEGAGTVFVIDEATGNIHVTKSLDREEKAQYVLLAQAVDRASNRPLEPPSEFIIKVQDINDNPPIFPLGPYHATVPEMSNVGTSVIQVTAHDADDPSYGNSAKLVYTVLDGLPFFSVDPQTGVVRTAIPNMDRETQEEFLVVIQAKDMGGHMGGLSGSTTVTVTLSDVNDNPPKFPQSLYQFSVVETAGPGTLVGRLRAQDPDLGDNALMAYSILDGEGSEAFSISTDLQGRDGLLTVRKPLDFESQRSYSFRVEATNTLIDPAYLRRGPFKDVASVRVAVQDAPEPPAFTQAAYHLTVPENKAPGTLVGQISAADLDSPASPIRYSILPHSDPERCFSIQPEEGTIHTAAPLDREARAWHNLTVLATELGWSWGPERGWVPLLVAEWSAPAAPPQRSPVGSAVGIPQDSSAQASRVQVAIQTLDENDNAPQLAEPYDTFVCDSAAPGQLIQVIRALDRDEVGNSSHVSFQGPLGPDANFTVQDNRDGSASLLLPSRPAPPRHAPYLVPIELWDWGQPALSSTATVTVSVCRCQPDGSVASCWPEAHLSAAGLSTGA

SEQ ID NO: 1097 - protein, 587 aa, synthetic construct
  REGION 1..587: note = CDH26 (Q8IXH8) ECD
DSVQQETDDLTKQTKEKIYQPLRRSKRRWVITTLELEEEDPGPFPKLIGELFNNMSYNMSLMYLISGPGVDEYPEIGLFSLEDHENGRIYVHRPVDREMTPSFTVYFDVVERSTGKIVDTSLIFNIRISDVNDHAPQFPEKEFNITVQENQSAGQPIFQMLAVDLDEENTPNSQVLYFLISQTPLLKESGFRVDRLSGEIRLSGCLDYETAPQFTLLIRARDCGEPSLSSTTTVHVDVQEGNNHRPAFTQENYKVQIPEGRASQGVLRLLVQDRDSPFTSAWRAKFNILHGNEEGHFDISTDPETNEGILNVIKPLDYETRPAQSLIIVVENEERLVFCERGKLQPPRKAAASATVSVQVTDANDPPAFHPQSFIVNKEEGARPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLH

SEQ ID NO: 1098 - protein, 547 aa, synthetic construct
  REGION 1..547: note = CDH3 (P22223) ECD
DWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGG

SEQ ID NO: 1099 - protein, 565 aa, synthetic construct
  REGION 1..565: note = CDH4 (P55283) ECD
DWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGA

SEQ ID NO: 1100 - protein, 552 aa, synthetic construct
  REGION 1..552: note = CDH5 (P33151) ECD
DWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFILNTENNFTLTDNHDNTANITVKYGQFDREHTKVHFLPVVISDNGMPSRTGTSTLTVAVCKCNEQGEFTFCEDMAAQVGVSIQ

SEQ ID NO: 1101 - protein, 562 aa, synthetic construct
  REGION 1..562: note = CDH6 (P55285) ECD
SWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKLLDFEKKKVYTLKVEASNPYVEPRFLYLGPFKDSATVRIVVEDVDEPPVFSKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEFAEFYETFVCEKAKADQLIQTLHAVDKDDPYSGHQFSFSLAPEAASGSNFTIQDNKDNTAGILTRKNGYNRHEMSTYLLPVVISDNDYPVQSSTGTVTVRVCACDHHGNMQSCHAEALIHPTGLSTGA

SEQ ID NO: 1102 - protein, 580 aa, synthetic construct
  REGION 1..580: note = CDH7 (Q9ULB5) ECD
ELSRSRSKPYFQSGRSRTKRSWVWNQFFVLEEYMGSDPLYVGKLHSDVDKGDGSIKYILSGEGASSIFIIDENTGDIHATKRLDREEQAYYTLRAQALDRLTNKPVEPESEFVIKIQDINDNEPKFLDGPYTAGVPEMSPVGTSVVQVTATDADDPTYGNSARVVYSILQGQPYFSVEPKTGVIKTALPNMDREAKDQYLLVIQAKDMVGQNGGLSGTTSVTVTLTDVNDNPPRFPRRSYQYNVPESLPVASVVARIKAADADIGANAEMEYKIVDGDGLGIFKISVDKETQEGIITIQKELDFEAKTSYTLRIEAANKDADPRFLSLGPFSDTTTVKIIVEDVDEPPVFSSPLYPMEVSEATQVGNIIGTVAAHDPDSSNSPVRYSIDRNTDLERYFNIDANSGVITTAKSLDRETNAIHNITVLAMESQNPSQVGRGYVAITILDINDNAPEFAMDYETTVCENAQPGQVIQKISAVDKDEPSNGHQFYFSLTTDATNNHNFSLKDNKDNTASILTRRNGFRRQEQSVYYLPIFIVDSGSPSLSSTNTLTIRVCDCDADGVAQTCNAEAYVLPAGLST

SEQ ID NO: 1103 - protein, 560 aa, synthetic construct
  REGION 1..560: note = CDH8 (P55286) ECD
GWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSM

SEQ ID NO: 1104 - protein, 562 aa, synthetic construct
  REGION 1..562: note = CDH9 (Q9ULB4) ECD
GWMWNQFFLLEEYTGTDTQYVGKLHTDQDKGDGNLKYILTGDGAGSLFVIDENTGDIHAAKKLDREEKSLYILRAKAIDRKTGRQVEPESEFIIKIHDINDNEPKFTKDLYTASVPEMSGVGTSVIQVTATDADDANYGNSAKVVYSILQGQPYFSVDPESGIIKTALPDMSRENREQYQVVIQAKDMGGQMGGLSGTTTVNITLTDVNNNPPRFPQSTYQFNSPESVPLGTHLGRIKANDPDVGENAEMEYSIAEGDGADMFDVITDKDTQEGIITVKQNLDFENQMLYTLRVDASNTHPDPRFLHLGPFKDTAVVKISVEDIDEPPVFTKVSYLIEVDEDVKEGSIIGQVTAYDPDARNNLIKYSVDRHTDMDRIFGIHSENGSIFTLKALDRESSPWHNITVTATEINNPKQSSHIPVFIRILDINDHAPEFAMYYETFVCENAKPGQLIQTVSVMDKDDPPRGHKFFFEPVPEFTLNPNFTIVDNKDNTAGIMTRKDGYSRNKMSTYLLPILIFDNDYPIQSSTGTLTIRVCACDNQGNMQSCTAEALILSAGLSTGA

SEQ ID NO: 1105 - protein, 681 aa, synthetic construct
  REGION 1..681: note = CDHR1 (Q96JP9) ECD
QANFAPHFFDNGVGSTNGNMALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMK

SEQ ID NO: 1106 - protein, 1134 aa, synthetic construct
  REGION 1..1134: note = CDHR2 (Q9BYE9) ECD
NVAPKFLANMTSVILPEDLPVGAQAFWLVAEDQDNDPLTYGMSGPNAYFFAVTPKTGEVKLASALDYETLYTFKVTISVSDPYIQVQREMLVIVEDRNDNAPVFQNTAFSTSINETLPVGSVVFSVLAVDKDMGSAGMVVYSIEKVIPSTGDSEHLFRILANGSIVLNGSLSYNNKSAFYQLELKACDLGGMYHNTFTIQCSLPVFLSISVVDQPDLDPQFVREFYSASVAEDAAKGTSVLTVEAVDGDKGINDPVIYSISYSTRPGWFDIGADGVIRVNGSLDREQLLEADEEVQLQVTATETHLNIYGQEAKVSIWVTVRVMDVNDHKPEFYNCSLPACTFTPEEAQVNFTGYVDEHASPRIPIDDLTMVVYDPDKGSNGTFLLSLGGPDAEAFSVSPERAVGSASVQVLVRVSALVDYERQTAMAVQVVATDSVSQNFSVAMVTIHLRDINDHRPTFPQSLYVLTVPEHSATGSVVTDSIHATDPDTGAWGQITYSLLPGNGADLFQVDPVSGTVTVRNGELLDRESQAVYYLTLQATDGGNLSSSTTLQIHLLDINDNAPVVSGSYNIFVQEEEGNVSVTIQAHDNDEPGTNNSRLLFNLLPGPYSHNFSLDPDTGLLRNLGPLDREAIDPALEGRIVLTVLVSDCGEPVLGTKVNVTITVEDINDNLPIFNQSSYNFTVKEEDPGVLVGVVKAWDADQTEANNRISFSLSGSGANYFMIRGLVLGAGWAEGYLRLPPDVSLDYETQPVFNLTVSAENPDPQGGETIVDVCVNVKDVNDNPPTLDVASLRGIRVAENGSQHGQVAVVVASDVDTSAQLEIQLVNILCTKAGVDVGSLCWGWFSVAANGSVYINQSKAIDYEACDLVTLVVRACDLATDPGFQAYSNNGSLLITIEDVNDNAPYFLPENKTFVIIPELVLPNREVASVRARDDDSGNNGVILFSILRVDFISKDGATIPFQGVFSIFTSSEADVFAGSIQPVTSLDSTLQGTYQVTVQARDRPSLGPFLEATTTLNLFTVDQSYRSRLQFSTPKEEVGANRQAINAALTQATRTTVYIVDIQDIDSAARARPHSYLDAYFVFPNGSALTLDELSVMIRNDQDSLTQLLQLGLVVLGSQESQESDLSKQLIS

SEQ ID NO: 1107 - protein, 694 aa, synthetic construct
  REGION 1..694: note = CDHR3 (Q6ZTQ4) ECD
LHLILLPATGNVAENSPPGTSVHKFSVKLSASLSPVIPGFPQIVNSNPLTEAFRVNWLSGTYFEVVTTGMEQLDFETGPNIFDLQIYVKDEVGVTDLQVLTVQVTDVNEPPQFQGNLAEGLHLYIVERANPGFIYQVEAFDPEDTSRNIPLSYFLISPPKSFRMSANGTLFSTTELDFEAGHRSFHLIVEVRDSGGLKASTELQVNIVNLNDEVPRFTSPTRVYTVLEELSPGTIVANITAEDPDDEGFPSHLLYSITTVSKYFMINQLTGTIQVAQRIDRDAGELRQNPTISLEVLVKDRPYGGQENRIQITFIVEDVNDNPATCQKFTFSIMVPERTAKGTLLLDLNKFCFDDDSEAPNNRFNFTMPSGVGSGSRFLQDPAGSGKIVLIGDLDYENPSNLAAGNKYTVIIQVQDVAPPYYKNNVYVYILTSPENEFPLIFDRPSYVFDVSERRPARTRVGQVRATDKDLPQSSLLYSISTGGASLQYPNVFWINPKTGELQLVTKVDCETTPIYILRIQATNNEDTSSVTVTVNILEENDEKPICTPNSYFLALPVDLKVGTNIQNFKLTCTDLDSSPRSFRYSIGPGNVNNHFTFSPNAGSNVTRLLLTSRFDYAGGFDKIWDYKLLVYVTDDNLMSDRKKAEALVETGTVTLSIKVIPHPTTIITTTPRPRVTYQVLRKNVYSPSAWYVP

SEQ ID NO: 1108 - protein, 670 aa, synthetic construct
  REGION 1..670: note = CDHR4 (A6H8M9) ECD
DLCSLPCFINVSESQGPGTVLQFLSFNCSSYTPTPTLELLNVQPPTTFFNPPSLARWQGTYVGKLTLSSSAQLDALMVNHYKVQLKFTCGNHVMEGSLSVDVQRDLSHIQCAGQFASPAGEMIQVPETVTPGARLYTLLLPGLELHGAQMSIISAQDLPHFPGPFSINEQGWLQAPSQGLLGQAQKVFQLQISVSFGQRQSCQGMVIVKVLPVPSSQVSFLEQAQNITIPENLAPGSEVVQVQARGVDLRYEILSPVPSPLFSIGRADGVVRTTTPLELARTSGTAVSRLQVKAFEQGQLWASAKLNLTMNVQLVNLWPPRCLPALLVSQIPETAPVGTVLNTLTCEDPDSVGATLDYKLWFRSSSNPASLCLYDRVLEVNATLDCDTPGACFQHAASILVLDGGQPQMTTEVPVLVMVTPINEFSPACAPRTFRVQEDAAPHTLLGSVVGTDMDYPHDNIEYYTSGGPTTFAVDRLSGEVHLLGPLDYEQQRLYRLTVLVIDHGQDQNPNHHLSGSCTITIEVEDVNDHAPECEPPFQELTIYAPLGRSVEVTKMSCQIPQEPQRLIYSYSIVGGNSQNRFILQGAILVHSDLVLGPFWPEQPRTYELLICVADAGPSTPHLSTTATIIVHLVPRRASTVATSTHRTTVPSTMTPMLVTDTEAFWQPQP

SEQ ID NO: 1109 - protein, 644 aa, synthetic construct
  REGION 1..644: note = CDHR5 (Q9HBB8) ECD
QAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQRLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGPPGAENSTSHQPATPGGDTAQTPKPGTSQPMPPGVGTSTSHQPATPSGGTAQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMA

SEQ ID NO: 1110 - protein, 938 aa, synthetic construct
  REGION 1..938: note = CDON (Q4KMG0) ECD
DLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMLTFRTSKEKTASSKNTQASSPPVGIPKYPVVSEAANNNFGVVLTDSSRHSGVPEAPDRPTISTASETSVYVTWIPRANGGSPITAFKVEYKRMRTSNWLVAAEDIPPSKLSVEVRSLEPGSTYKFRVIAINHYGESFRSSASRPYQVVGFPNRFSSRPITGPHIAYTEAVSDTQIMLKWTYIPSSNNNTPIQGFYIYYRPTDSDNDSDYKRDVVEGSKQWHMIGHLQPETSYDIKMQCFNEGGESEFSNVMICETKVKRVPGASEYPVKDLSTPPNSLGSGGNVGPATSPARSSD

SEQ ID NO: 1111 - protein, 394 aa, synthetic construct
  REGION 1..394: note = CEACAM1 (P13688) ECD
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPG

SEQ ID NO: 1112 - protein, 125 aa, synthetic construct
  REGION 1..125: note = CEACAM19 (Q7Z692) ECD
ALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAEKNKELPSTHLPTNAG

SEQ ID NO: 1113 - protein, 420 aa, synthetic construct
  REGION 1..420: note = CEACAM20 (Q6UY09) ECD
QLTLNANPLDATQSEDVVLPVFGTPRTPQIHGRSRELAKPSIAVSPGTAIEQKDMVTFYCTTKDVNITIHWVSNNLSIVFHERMQLSKDGKILTILIVQREDSGTYQCEARDALLSQRSDPIFLDVKYGPDPVEIKLESGVASGEVVEVMEGSSMTFLAETKSHPPCAYTWFLLDSILSHTTRTFTIHAVSREHEGLYRCLVSNSATHLSSLGTLKVRVLETLTMPQVVPSSLNLVENARSVDLTCQTVNQSVNVQWFLSGQPLLPSEHLQLSADNRTLIIHGLQRNDTGPYACEVWNWGSRARSEPLELTINYGPDQVHITRESASEMISTIEAELNSSLTLQCWAESKPGAEYRWTLEHSTGEHLGEQLIIRALTWEHDGIYNCTASNSLTGLARSTSVLVKVVGPQSSSLSSGAIAG

SEQ ID NO: 1114 - protein, 206 aa, synthetic construct
  REGION 1..206: note = CEACAM21 (Q3KPI0) ECD
WLFIASAPFEVAEGENVHLSVVYLPENLYSYGWYKGKTVEPNQLIAAYVIDTHVRTPGPAYSGRETISPSGDLHFQNVTLEDTGYYTLQVTYRNSQIEQASHHLRVYESVAQPSIQASSTTVTEKGSVVLTCHTNNTGTSFQWIFNNQRLQVTKRMKLSWFNHMLTIDPIRQEDAGEYQCEVSNPVSSNRSDPLKLTVKSDDNTLG

SEQ ID NO: 1115 - protein, 121 aa, synthetic construct
  REGION 1..121: note = CEACAM3 (P40198) ECD
KLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYQENAPGLPVGAVAG

SEQ ID NO: 1116 - protein, 120 aa, synthetic construct
  REGION 1..120: note = CEACAM4 (O75871) ECD
FTIEALPSSAAEGKDVLLLACNISETIQAYYWHKGKTAEGSPLIAGYITDIQANIPGAAYSGRETVYPNGSLLFQNITLEDAGSYTLRTINASYDSDQATGQLHVHQNNVPGLPVGAVAG

SEQ ID NO: 1117 - protein, 1058 aa, synthetic construct
  REGION 1..1058: note = CHL1 (O00533) ECD
IEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSSNSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGW

SEQ ID NO: 1118 - protein, 195 aa, synthetic construct
  REGION 1..195: note = CHODL (Q9H9P2) ECD
RRVVSGQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPN

SEQ ID NO: 1119 - protein, 870 aa, synthetic construct
  REGION 1..870: note = CLCA2 (Q9UQC9) ECD
GVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVQAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVKVEEELTLSWTAPGEDFDQGQATSYEIRMSKSLQNIQDDFNNAILVNTSKRNPQQAGIREIFTFSPQISTNGPEHQPNGETHESHRIYVAIRAMDRNSLQSAVSNIAQAPLFIPPNSDPVPARDYL

SEQ ID NO: 1120 - protein, 873 aa, synthetic construct
  REGION 1..873: note = CLCA4 (Q14CN2) ECD
SFIKLNNNGFEDIVIVIDPSVPEDEKIIEQIEDMVTTASTYLFEATEKRFFFKNVSILIPENWKENPQYKRPKHENHKHADVIVAPPTLPGRDEPYTKQFTECGEKGEYIHFTPDLLLGKKQNEYGPPGKLFVHEWAHLRWGVFDEYNEDQPFYRAKSKKIEATRCSAGISGRNRVYKCQGGSCLSRACRIDSTTKLYGKDCQFFPDKVQTEKASIMFMQSIDSVVEFCNEKTHNQEAPSLQNIKCNFRSTWEVISNSEDFKNTIPMVTPPPPPVFSLLKISQRIVCLVLDKSGSMGGKDRLNRMNQAAKHFLLQTVENGSWVGMVHFDSTATIVNKLIQIKSSDERNTLMAGLPTYPLGGTSICSGIKYAFQVIGELHSQLDGSEVLLLTDGEDNTASSCIDEVKQSGAIVHFIALGRAADEAVIEMSKITGGSHFYVSDEAQNNGLIDAFGALTSGNTDLSQKSLQLESKGLTLNSNAWMNDTVIIDSTVGKDTFFLITWNSLPPSISLWDPSGTIMENFTVDATSKMAYLSIPGTAKVGTWAYNLQAKANPETLTITVTSRAANSSVPPITVNAKMNKDVNSFPSPMIVYAEILQGYVPVLGANVTAFIESQNGHTEVLELLDNGAGADSFKNDGVYSRYFTAYTENGRYSLKVRAHGGANTARLKLRPPLNRAAYIPGWVVNGEIEANPPRPEIDEDTQTTLEDFSRTASGGAFVVSQVPSLPLPDQYPPSQITDLDATVHEDKIILTWTAPGDNFDVGKVQRYIIRISASILDLRDSFDDALQVNTTDLSPKEANSKESFAFKPENISEENATHIFIAIKSIDKSNLTSKVSNIAQVTLFIPQANPDDIDPTPTPTPTPTPDKSHNSG

SEQ ID NO: 1121 - protein, 376 aa, synthetic construct
  REGION 1..376: note = CLEC14A (Q86T13) ECD
EHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRSCVTSGEGQPTLGGTGVPTRRPPATATSPVPQRTWPIRVDEKLGETPLVPEQDNSVTSIPEIPRWGSQSTMSTLQMSLQAESKATITPSGSVISKFNSTTSSATPQAFDSSSA

SEQ ID NO: 1122 - protein, 217 aa, synthetic construct
  REGION 1..217: note = CLMP (Q9H6B4) ECD
THTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVA

SEQ ID NO: 1123 - protein, 831 aa, synthetic construct
  REGION 1..831: note = CLSTN1 (O94985) ECD
ARVNKHKPWLEPTYHGIVTENDNTVLLDPPLIALDKDAPLRFAESFEVTVTKEGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPST

SEQ ID NO: 1124 - protein, 811 aa, synthetic construct
  REGION 1..811: note = CLSTN2 (Q9H4D0) ECD
SGGGGDSRQRRLLAAKVNKHKPWIETSYHGVITENNDTVILDPPLVALDKDAPVPFAGEICAFKIHGQELPFEAVVLNKTSGEGRLRAKSPIDCELQKEYTFIIQAYDCGAGPHETAWKKSHKAVVHIQVKDVNEFAPTFKEPAYKAVVTEGKIYDSILQVEAIDEDCSPQYSQICNYEIVTTDVPFAIDRNGNIRNTEKLSYDKQHQYEILVTAYDCGQKPAAQDTLVQVDVKPVCKPGWQDWTKRIEYQPGSGSMPLFPSIHLETCDGAVSSLQIVTELQTNYIGKGCDRETYSEKSLQKLCGASSGIIDLLPSPSAATNWTAGLLVDSSEMIFKFDGRQGAKVPDGIVPKNLTDQFTITMWMKHGPSPGVRAEKETILCNSDKTEMNRHHYALYVHNCRLVFLLRKDFDQADTFRPAEFHWKLDQICDKEWHYYVINVEFPVVTLYMDGATYEPYLVTNDWPIHPSHIAMQLTVGACWQGGEVTKPQFAQFFHGSLASLTIRPGKMESQKVISCLQACKEGLDINSLESLGQGIKYHFNPSQSILVMEGDDIGNINRALQKVSYINSRQFPTAGVRRLKVSSKVQCFGEDVCISIPEVDAYVMVLQAIEPRITLRGTDHFWRPAAQFESARGVTLFPDIKIVSTFAKTEAPGDVKTTDPKSEVLEEMLHNLDFCDILVIGGDLDPRQECLELNHSELHQRHLDATNSTAGYSIYGVGSMSRYEQVLHHIRYRNWRPASLEARRFRIKCSELNGRYTSNEFNLEVSILHEDQVSDKEHVNHLIVQPPFLQSVHHPESRSSIQHSSVVPS

SEQ ID NO: 1125 - protein, 828 aa, synthetic construct
  REGION 1..828: note = CLSTN3 (Q9BQT9) ECD
NKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSA

SEQ ID NO: 1126 - protein, 1264 aa, synthetic construct
  REGION 1..1264: note = CNTNAP1 (P78357) ECD
WGYYGCDEELVGPLYARSLGASSYYSLLTAPRFARLHGISGWSPRIGDPNPWLQIDLMKKHRIRAVATQGSFNSWDWVTRYMLLYGDRVDSWTPFYQRGHNSTFFGNVNESAVVRHDLHFHFTARYIRIVPLAWNPRGKIGLRLGLYGCPYKADILYFDGDDAISYRFPRGVSRSLWDVFAFSFKTEEKDGLLLHAEGAQGDYVTLELEGAHLLLHMSLGSSPIQPRPGHTTVSAGGVLNDQHWHYVRVDRFGRDVNFTLDGYVQRFILNGDFERLNLDTEMFIGGLVGAARKNLAYRHNFRGCIENVIFNRVNIADLAVRRHSRITFEGKVAFRCLDPVPHPINFGGPHNFVQVPGFPRRGRLAVSFRFRTWDLTGLLLFSRLGDGLGHVELTLSEGQVNVSIAQSGRKKLQFAAGYRLNDGFWHEVNFVAQENHAVISIDDVEGAEVRVSYPLLIRTGTSYFFGGCPKPASRWDCHSNQTAFHGCMELLKVDGQLVNLTLVEGRRLGFYAEVLFDTCGITDRCSPNMCEHDGRCYQSWDDFICYCELTGYKGETCHTPLYKESCEAYRLSGKTSGNFTIDPDGSGPLKPFVVYCDIRENRAWTVVRHDRLWTTRVTGSSMERPFLGAIQYWNASWEEVSALANASQHCEQWIEFSCYNSRLLNTAGGYPYSFWIGRNEEQHFYWGGSQPGIQRCACGLDRSCVDPALYCNCDADQPQWRTDKGLLTFVDHLPVTQVVIGDTNRSTSEAQFFLRPLRCYGDRNSWNTISFHTGAALRFPPIRANHSLDVSFYFRTSAPSGVFLENMGGPYCQWRRPYVRVELNTSRDVVFAFDVGNGDENLTVHSDDFEFNDDEWHLVRAEINVKQARLRVDHRPWVLRPMPLQTYIWMEYDQPLYVGSAELKRRPFVGCLRAMRLNGVTLNLEGRANASEGTSPNCTGHCAHPRLPCFHGGRCVERYSYYTCDCDLTAFDGPYCNHDIGGFFEPGTWMRYNLQSALRSAAREFSHMLSRPVPGYEPGYIPGYDTPGYVPGYHGPGYRLPDYPRPGRPVPGYRGPVYNVTGEEVSFSFSTSSAPAVLLYVSSFVRDYMAVLIKDDGTLQLRYQLGTSPYVYQLTTRPVTDGQPHSINITRVYRNLFIQVDYFPLTEQKFSLLVDSQLDSPKALYLGRVMETGVIDPEIQRYNTPGFSGCLSGVRFNNVAPLKTHFRTPRPMTAELAEALRVQGELSESNCGAMPRLVSEVPPELDPWYLPPDFPYYHDEGWVA

SEQ ID NO: 1127 - protein, 1235 aa, synthetic construct
  REGION 1..1235: note = CNTNAP2 (Q9UHC6) ECD
APSTSQKCDEPLVSGLPHVAFSSSSSISGSYSPGYAKINKRGGAGGWSPSDSDHYQWLQVDFGNRKQISAIATQGRYSSSDWVTQYRMLYSDTGRNWKPYHQDGNIWAFPGNINSDGVVRHELQHPIIARYVRIVPLDWNGEGRIGLRIEVYGCSYWADVINFDGHVVLPYRFRNKKMKTLKDVIALNFKTSESEGVILHGEGQQGDYITLELKKAKLVLSLNLGSNQLGPIYGHTSVMTGSLLDDHHWHSVVIERQGRSINLTLDRSMQHFRTNGEFDYLDLDYEITFGGIPFSGKPSSSSRKNFKGCMESINYNGVNITDLARRKKLEPSNVGNLSFSCVEPYTVPVFFNATSYLEVPGRLNQDLFSVSFQFRTWNPNGLLVFSHFADNLGNVEIDLTESKVGVHINITQTKMSQIDISSGSGLNDGQWHEVRFLAKENFAILTIDGDEASAVRTNSPLQVKTGEKYFFGGFLNQMNNSSHSVLQPSFQGCMQLIQVDDQLVNLYEVAQRKPGSFANVSIDMCAIIDRCVPNHCEHGGKCSQTWDSFKCTCDETGYSGATCHNSIYEPSCEAYKHLGQTSNYYWIDPDGSGPLGPLKVYCNMTEDKVWTIVSHDLQMQTPVVGYNPEKYSVTQLVYSASMDQISAITDSAEYCEQYVSYFCKMSRLLNTPDGSPYTWWVGKANEKHYYWGGSGPGIQKCACGIERNCTDPKYYCNCDADYKQWRKDAGFLSYKDHLPVSQVVVGDTDRQGSEAKLSVGPLRCQGDRNYWNAASFPNPSSYLHFSTFQGETSADISFYFKTLTPWGVFLENMGKEDFIKLELKSATEVSFSFDVGNGPVEIVVRSPTPLNDDQWHRVTAERNVKQASLQVDRLPQQIRKAPTEGHTRLELYSQLFVGGAGGQQGFLGCIRSLRMNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSA

SEQ ID NO: 1128 - protein, 1220 aa, synthetic construct
  REGION 1..1220: note = CNTNAP3 (Q9BZ76) ECD
GNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSTKKQVILSSGTEFNAVKSLILGKVLEAAGADPDTRRAATSGFTGCLSAVRFGRAAPLKAALRPSGPSRVTVRGHVAPMARCAAGAASGSPARELAPRLAGGAGRSGPADEGEPLVNADRRDSA

SEQ ID NO: 1129 - protein, 1220 aa, synthetic construct
  REGION 1..1220: note = CNTNAP3B (Q96NU0) ECD
GNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGGCLGNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEWTSDTIVLSQKEHLPVTQIVMTDTGQPHSEADYTLGPLLCRGDKSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSAKKQVILSSGTEFNAVKSLILGKVLEAAGADPDTRRAATSGFTGCLSAVRFGCAAPLKAALRPSGPSRVTVRGHVAPMARCAAGAASGSPARELAPRLAGGAGRSGPVDEGEPLVNADRRDSA

SEQ ID NO: 1130 - protein, 1216 aa, synthetic construct
  REGION 1..1216: note = CNTNAP4 (Q9C0A0) ECD
GNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSA

SEQ ID NO: 1131 - protein, 1213 aa, synthetic construct
  REGION 1..1213: note = CNTNAP5 (Q8WYK1) ECD
ATNYNCDDPLASLLSPMAFSSSSDLTGTHSPAQLNWRVGTGGWSPADSNAQQWLQMDLGNRVEITAVATQGRYGSSDWVTSYSLMFSDTGRNWKQYKQEDSIWTFAGNMNADSVVHHKLLHSVRARFVRFVPLEWNPSGKIGMRVEVYGCSYKSDVADFDGRSSLLYRFNQKLMSTLKDVISLKFKSMQGDGVLFHGEGQRGDHITLELQKGRLALHLNLGDSKARLSSSLPSATLGSLLDDQHWHSVLIERVGKQVNFTVDKHTQHFRTKGETDALDIDYELSFGGIPVPGKPGTFLKKNFHGCIENLYYNGVNIIDLAKRRKHQIYTGNVTFSCSEPQIVPITFVNSSGSYLLLPGTPQIDGLSVSFQFRTWNKDGLLLSTELSEGSGTLLLSLEGGILRLVIQKMTERVAEILTGSNLNDGLWHSVSINARRNRITLTLDDEAAPPAPDSTWVQIYSGNSYYFGGCPDNLTDSQCLNPIKAFQGCMRLIFIDNQPKDLISVQQGSLGNFSDLHIDLCSIKDRCLPNYCEHGGSCSQSWTTFYCNCSDTSYTGATCHNSIYEQSCEVYRHQGNTAGFFYIDSDGSGPLGPLQVYCNITEDKIWTSVQHNNTELTRVRGANPEKPYAMALDYGGSMEQLEAVIDGSEHCEQEVAYHCRRSRLLNTPDGTPFTWWIGRSNERHPYWGGSPPGVQQCECGLDESCLDIQHFCNCDADKDEWTNDTGFLSFKDHLPVTQIVITDTDRSNSEAAWRIGPLRCYGDRRFWNAVSFYTEASYLHFPTFHAEFSADISFFFKTTALSGVFLENLGIKDFIRLEISSPSEITFAIDVGNGPVELVVQSPSLLNDNQWHYVRAERNLKETSLQVDNLPRSTRETSEEGHFRLQLNSQLFVGGTSSRQKGFLGCIRSLHLNGQKMDLEERAKVTSGVRPGCPGHCSSYGSICHNGGKCVEKHNGYLCDCTNSPYEGPFCKKEVSAVFEAGTSVTYMFQEPYPVTKNISLSSSAIYTDSAPSKENIALSFVTTQAPSLLLFINSSSQDFVVVLLCKNGSLQVRYHLNKEETHVFTIDADNFANRRMHHLKINREGRELTIQMDQQLRLSYNFSPEVEFRVIRSLTLGKVTENLGLDSEVAKANAMGFAGCMSSVQYNHIAPLKAALRHATVAPVTVHGTLTESSCGFMVDSDVNAVTTVHSSSDPFGKTDEREPLTNAVRSDS

SEQ ID NO: 1132 - protein, 1268 aa, synthetic construct
  REGION 1..1268: note = CPD (O75976) ECD
AHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTNLGQSTEYRHIWSLEISNKPNVSEPEEPKIRFVAGIHGNAPVGTELLLALAEFLCLNYKKNPAVTQLVDRTRIVIVPSLNPDGRERAQEKDCTSKIGQTNARGKDLDTDFTNNASQPETKAIIENLIQKQDFSLSVALDGGSMLVTYPYDKPVQTVENKETLKHLASLYANNHPSMHMGQPSCPNKSDENIPGGVMRGAEWHSHLGSMKDYSVTYGHCPEITVYTSCCYFPSAARLPSLWADNKRSLLSMLVEVHKGVHGFVKDKTGKPISKAVIVLNEGIKVQTKEGGYFHVLLAPGVHNIIAIADGYQQQHSQVFVHHDAASSVVIVFDTDNRIFGLPRE

SEQ ID NO: 1133 - protein, 1930 aa, synthetic construct
  REGION 1..1930: note = CR1 (P17927) ECD
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHD

SEQ ID NO: 1134 - protein, 951 aa, synthetic construct
  REGION 1..951: note = CR2 (P20023) ECD
ISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSR

SEQ ID NO: 1135 - protein, 1322 aa, synthetic construct
  REGION 1..1322: note = CRB1 (P82279) ECD
FCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTT

SEQ ID NO: 1136 - protein, 1196 aa, synthetic construct
  REGION 1..1196: note = CRB2 (Q5IJ48) ECD
LLAGTVPSEPPSACASDPCAPGTECQATESGGYTCGPMEPRGCATQPCHHGALCVPQGPDPTGFRCYCVPGFQGPRCELDIDECASRPCHHGATCRNLADRYECHCPLGYAGVTCEMEVDECASAPCLHGGSCLDGVGSFRCVCAPGYGGTRCQLDLDECQSQPCAHGGTCHDLVNGFRCDCAGTGYEGTHCEREVLECASAPCEHNASCLEGLGSFRCLCWPGYSGELCEVDEDECASSPCQHGGRCLQRSDPALYGGVQAAFPGAFSFRHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPSKECSLNVTCLDGSPCEGGSPAANCSCLEGLAGQRCQVPTLPCEANPCLNGGTCRAAGGVSECICNARFSGQFCEVAKGLPLPLPFPLLE

SEQ ID NO: 1137 - protein, 33 aa, synthetic construct
  REGION 1..33: note = CRB3 (Q9BUF7) ECD
QIQTTSANENSTVLPSSTSSSSDGNLRPEAITA

SEQ ID NO: 1138 - protein, 905 aa, synthetic construct
  REGION 1..905: note = CRIM1 (Q9NZV1) ECD
LVCLPCDESKCEEPRNCPGSIVQGVCGCCYTCASQRNESCGGTFGIYGTCDRGLRCVIRPPLNGDSLTEYEAGVCEDENWTDDQLLGFKPCNENLIAGCNIINGKCECNTIRTCSNPFEFPSQDMCLSALKRIEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVNDTKPACVFNNVEYYDGDMFRMDNCRFCRCQGGVAICFTAQCGEINCERYYVPEGECCPVCEDPVYPFNNPAGCYANGLILAHGDRWREDDCTFCQCVNGERHCVATVCGQTCTNPVKVPGECCPVCEEPTIITVDPPACGELSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDS

SEQ ID NO: 1139 - protein, 209 aa, synthetic construct
  REGION 1..209: note = CRLF2 (Q9HC73) ECD
QGGAAEGVQIQIIYFNLETVQVTWNASKYSRTNLTFHYRFNGDEAYDQCTNYLLQEGHTSGCLLDAEQRDDILYFSIRNGTHPVFTASRWMVYYLKPSSPKHVRFSWHQDAVTVTCSDLSYGDLLYEVQYRSPFDTEWQSKQENTCNVTIEGLDAEKCYSFWVRVKAMEDVYGPDTYPSDWSEVTCWQRGEIRDACAETPTPPKPKLSK

SEQ ID NO: 1140 - protein, 270 aa, synthetic construct
  REGION 1..270: note = CRTAM (O95727) ECD
SLTNHTETITVEEGQTLTLKCVTSLRKNSSLQWLTPSGFTIFLNEYPALKNSKYQLLHHSANQLSITVPNVTLQDEGVYKCLHYSDSVSTKEVKVIVLATPFKPILEASVIRKQNGEEHVVLMCSTMRSKPPPQITWLLGNSMEVSGGTLHEFETDGKKCNTTSTLIIHTYGKNSTVDCIIRHRGLQGRKLVAPFRFEDLVTDEETASDALERNSLSSQDPQQPTSTVSVTEDSSTSEIDKEEKEQTTQDPDLTTEANPQYLGLARKKSG

SEQ ID NO: 1141 - protein, 464 aa, synthetic construct
  REGION 1..464: note = CSF1 (P09603) ECD
EEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSFSPQLQES

SEQ ID NO: 1142 - protein, 498 aa, synthetic construct
  REGION 1..498: note = CSF1R (P07333) ECD
IPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTP

SEQ ID NO: 1143 - protein, 298 aa, synthetic construct
  REGION 1..298: note = CSF2RA (P15509) ECD
EKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDG

SEQ ID NO: 1144 - protein, 427 aa, synthetic construct
  REGION 1..427: note = CSF2RB (P32927) ECD
WERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMW

SEQ ID NO: 1145 - protein, 603 aa, synthetic construct
  REGION 1..603: note = CSF3R (Q99062) ECD
ECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELH

SEQ ID NO: 1146 - protein, 3461 aa, synthetic construct
  REGION 1..3461: note = CSMD1 (Q96PZ7) ECD
AKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGS

SEQ ID NO: 1147 - protein, 2195 aa, synthetic construct
  REGION 1..2195: note = CSPG4 (Q6UVK1) ECD
ASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFS

SEQ ID NO: 1148 - protein, 393 aa, synthetic construct
  REGION 1..393: note = CSPG5 (O95196) ECD
VPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMC

SEQ ID NO: 1149 - protein, 126 aa, synthetic construct [sequence omitted]

SEQ ID NO: 1150 - protein, 544 aa, synthetic construct
  REGION 1..544: note = CUZD1 (Q86UP6) ECD
EAEGNASCTVSLGGANMAETHKAMILQLNPSENCTWTIERPENKSIRIIFSYVQLDPDGSCESENIKVFDGTSSNGPLLGQVCSKNDYVPVFESSSSTLTFQIVTDSARIQRTVFVFYYFFSPNISIPNCGGYLDTLEGSFTSPNYPKPHPELAYCVWHIQVEKDYKIKLNFKEIFLEIDKQCKFDFLAIYDGPSTNSGLIGQVCGRVTPTFESSSNSLTVVLSTDYANSYRGFSASYTSIYAENINTTSLTCSSDRMRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNS

SEQ ID NO: 1151 - protein, 317 aa, synthetic construct
  REGION 1..317: note = CX3CL1 (P78423) ECD
QHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQ

SEQ ID NO: 1152 - protein, 218 aa, synthetic construct [sequence omitted]

SEQ ID NO: 1153 - protein, 176 aa, synthetic construct
  REGION 1..176: note = CXCL16 (Q9H2A7) ECD
NEGSVTGSCYCGKRISSDSPPSVQFMNRLRKHLRAYHRCLYYTRFQLLSWSVCGGNKDPWVQELMSCLDLKECGHAYSGIVAHQKHLLPTSPPISQASEGASSDIHTPAQMLLSTLQSTQRPTLPVGSLSSDKELTRPNETTIHTAGHSLAAGPEAGENQKQPEKNAGPTARTSAT

SEQ ID NO: 1154 - protein, 96 aa, synthetic construct
  REGION 1..96: note = DAG1 (Q14118) ECD
SIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDV

SEQ ID NO: 1155 - protein, 425 aa, synthetic construct
  REGION 1..425: note = DCBLD1 (Q8N8Z6) ECD
EELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTV

SEQ ID NO: 1156 - protein, 462 aa, synthetic construct
  REGION 1..462: note = DCBLD2 (Q96PD2) ECD
QQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVA

SEQ ID NO: 1157 - protein, 1072 aa, synthetic construct
  REGION 1..1072: note = DCC (P43146) ECD
HLQVTGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDPTDPVDYYPLLDDFPTSVPDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSN

SEQ ID NO: 1158 - protein, 2898 aa, synthetic construct
  REGION 1..2898: note = DCHS1 (Q96JQ0) ECD
QAGSLDLQIDEEQPAGTLIGDISAGLPAGTAAPLMYFISAQEGSGVGTDLAIDEHSGVVRTARVLDREQRDRYRFTAVTPDGATVEVTVRVADINDHAPAFPQARAALQVPEHTAFGTRYPLEPARDADAGRLGTQGYALSGDGAGETFRLETRPGPDGTPVPELVVTGELDRENRSHYMLQLEAYDGGSPPRRAQALLDVTLLDINDHAPAFNQSRYHAVVSESLAPGSPVLQVFASDADAGVNGAVTYEINRRQSEGDGPFSIDAHTGLLQLERPLDFEQRRVHELVVQARDGGAHPELGSAFVTVHVRDANDNQPSMTVIFLSADGSPQVSEAAPPGQLVARISVSDPDDGDFAHVNVSLEGGEGHFALSTQDSVIYLVCVARRLDREERDAYNLRVTATDSGSPPLRAEAAFVLHVTDVNDNAPAFDRQLYRPEPLPEVALPGSFVVRVTARDPDQGTNGQVTYSLAPGAHTHWFSIDPTSGIITTAASLDYELEPQPQLIVVATDGGLPPLASSATVSVALQDVNDNEPQFQRTFYNASLPEGTQPGTCFLQVTATDADSGPFGLLSYSLGAGLGSSGSPPFRIDAHSGDVCTTRTLDRDQGPSSFDFTVTAVDGGGLKSMVYVKVFLSDENDNPPQFYPREYAASISAQSPPGTAVLRLRAHDPDQGSHGRLSYHILAGNSPPLFTLDEQSGLLTVAWPLARRANSVVQLEIGAEDGGGLQAEPSARVDISIVPGTPTPPIFEQLQYVFSVPEDVAPGTSVGIVQAHNPPGRLAPVTLSLSGGDPRGLFSLDAVSGLLQTLRPLDRELLGPVLELEVRAGSGVPPAFAVARVRVLLDDVNDNSPAFPAPEDTVLLPPNTAPGTPIYTLRALDPDSGVNSRVTFTLLAGGGGAFTVDPTTGHVRLMRPLGPSGGPAHELELEARDGGSPPRTSHFRLRVVVQDVGTRGLAPRFNSPTYRVDLPSGTTAGTQVLQVQAQAPDGGPITYHLAAEGASSPFGLEPQSGWLWVRAALDREAQELYILKVMAVSGSKAELGQQTGTATVRVSILNQNEHSPRLSEDPTFLAVAENQPPGTSVGRVFATDRDSGPNGRLTYSLQQLSEDSKAFRIHPQTGEVTTLQTLDREQQSSYQLLVQVQDGGSPPRSTTGTVHVAVLDLNDNSPTFLQASGAAGGGLPIQVPDRVPPGTLVTTLQAKDPDEGENGTILYTLTGPGSELFSLHPHSGELLTAAPLIRAERPHYVLTLSAHDQGSPPRSASLQLLVQVLPSARLAEPPPDLAERDPAAPVPVVLTVTAAEGLRPGSLLGSVAAPEPAGVGALTYTLVGGADPEGTFALDAASGRLYLARPLDFEAGPPWRALTVRAEGPGGAGARLLRVQVQVQDENEHAPAFARDPLALALPENPEPGAALYTFRASDADGPGPNSDVRYRLLRQEPPVPALRLDARTGALSAPRGLDRETTPALLLLVEATDRPANASRRRAARVSARVFVTDENDNAPVFASPSRVRLPEDQPPGPAALHVVARDPDLGEAARVSYRLASGGDGHFRLHSSTGALSVVRPLDREQRAEHVLTVVASDHGSPPRSATQVLTVSVADVNDEAPTFQQQEYSVLLRENNPPGTSLLTLRATDPDVGANGQVTYGGVSSESFSLDPDTGVLTTLRALDREEQEEINLTVYAQDRGSPPQLTHVTVRVAVEDENDHAPTFGSAHLSLEVPEGQDPQTLTMLRASDPDVGANGQLQYRILDGDPSGAFVLDLASGEFGTMRPLDREVEPAFQLRIEARDGGQPALSATLLLTVTVLDANDHAPAFPVPAYSVEVPEDVPAGTLLLQLQAHDPDAGANGHVTYYLGAGTAGAFLLEPSSGELRTAAALDREQCPSYTFSVSAVDGAAAGPLSTTVSVTITVRDVNDHAPTFPTSPLRLRLPRPGPSFSTPTLALATLRAEDRDAGANASILYRLAGTPPPGTTVDSYTGEIRVARSPVALGPRDRVLFIVATDLGRPARSATGVIIVGLQGEAERGPRFPRASSEATIRENAPPGTPIVSPRAVHAGGTNGPITYSILSGNEKGTFSIQPSTGAITVRSAEGLDFEVSPRLRLVLQAESGGAFAFTVLTLTLQDANDNAPRFLRPHYVAFLPESRPLEGPLLQVEADDLDQGSGGQISYSLAASQPARGLFHVDPTTGTITTTAILDREIWAETRLVLMATDRGSPALVGSATLTVMVIDTNDNRPTIPQPWELRVSEDALLGSEIAQVTGNDVDSGPVLWYVLSPSGPQDPFSVGRYGGRVSLTGPLDFEQCDRYQLQLLAHDGPHEGRANLTVLVEDVNDNAPAFSQSLYQVMLLEHTPPGSAILSVSATDRDSGANGHISYHLASPADGFSVDPNNGTLFTIVGTVALGHDGSGAVDVVLEARDHGAPGRAARATVHVQLQDQNDHAPSFTLSHYRVAVTEDLPPGSTLLTLEATDADGSRSHAAVDYSIISGNWGRVFQLEPRLAEAGESAGPGPRALGCLVLLEPLDFESLTQYNLTVAAADRGQPPQSSVVPVTVTVLDVNDNPPVFTRASYRVTVPEDTPVGAELLHVEASDADPGPHGLVRFTVSSGDPSGLFELDESSGTLRLAHALDCETQARHQLVVQAADPAGAHFALAPVTIEVQDVNDHGPAFPLNLLSTSVAENQPPGTLVTTLHAIDGDAGAFGRLRYSLLEAGPGPEGREAFALNSSTGELRARVPFDYEHTESFRLLVGAADAGNLSASVTVSVLVTGEDEYDPVFLAPAFHFQVPEGARRGHSLGHVQATDEDGGADGLVLYSLATSSPYFGINQTTGALYLRVDSRAPGSGTATSGGGGRTRREAPRELRLEVIARGPLPGSRSATVPVTVDITHTALGLAPDLNLLLVGA

SEQ ID NO: 1159 - protein, 449 aa, synthetic construct
  REGION 1..449: note = DCT (P40126) ECD
QFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTT

SEQ ID NO: 1160 - protein, 397 aa, synthetic construct
  REGION 1..397: note = DDR1 (Q08345) ECD
DMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTA

SEQ ID NO: 1161 - protein, 378 aa, synthetic construct
  REGION 1..378: note = DDR2 (Q16832) ECD
KAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTR

SEQ ID NO: 1162 - protein, 329 aa, synthetic construct
  REGION 1..329: note = DGCR2 (P98153) ECD
TEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMR

SEQ ID NO: 1163 - protein, 280 aa, synthetic construct
  REGION 1..280: note = DLK1 (P80370) ECD
AECFPACNPQNGFCEDDNVCRCQPGWQGPLCDQCVTSPGCLHGLCGEPGQCICTDGWDGELCDRDVRACSSAPCANNRTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQVSYECLCKPEFTGLTCVKKRALSPQQVTRLPSGYGLAYRLTPGVHELPVQQPEHRILKVSMKELNKKTPLLTEGQ

SEQ ID NO: 1164 - protein, 280 aa, synthetic construct
  REGION 1..280: note = DLK2 (Q6UY11) ECD
DDCSSHCDLAHGCCAPDGSCRCDPGWEGLHCERCVRMPGCQHGTCHQPWQCICHSGWAGKFCDKDEHICTTQSPCQNGGQCMYDGGGEYHCVCLPGFHGRDCERKAGPCEQAGSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPS

SEQ ID NO: 1165 - protein, 528 aa, synthetic construct
  REGION 1..528: note = DLL1 (O00548) ECD
QVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPW

SEQ ID NO: 1166 - protein, 466 aa, synthetic construct
  REGION 1..466: note = DLL3 (Q9NYJ7) ECD
AGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYL

SEQ ID NO: 1167 - protein, 503 aa, synthetic construct
  REGION 1..503: note = DLL4 (Q9NR61) ECD
SGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPW

SEQ ID NO: 1168 - protein, 606 aa, synthetic construct
  REGION 1..606: note = DNER (Q8NFT8) ECD
NPVPAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTWQPKTGQKVVEMKWDQVEVIPDIACGNASSNSSAGGRLVSFEVPQNTSVKIRQDATASLILLWKVTATGFQQCSLIDGRSVTPLQASGGLVLLEEMLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLY

SEQ ID NO: 1169 - protein, 419 aa, synthetic construct
  REGION 1..419: note = DPCR1 (Q3MIW9) ECD
TTFQEYQKTGELSTSDHIFPLTPGLVYSIPFDHIVLHSGQRPPELPKSTEIHEQKRHCNTTRHSKPTDKPTGNSKTIDHKSSTDNHEAPPTSEENSSNQGKDPMIRNQRSVDPADSTTTHKESAGKKHITPAPKSKINCRKSTTGKSTVTRKSDKTGRPLEKSMSTLDKTSTSSHKTTTSFHNSGNSQTKQKSTSFPEKITAASKTTYKTTGTPEESEKTEDSRTTVASDKLLTKTTKNIQETISANELTQSLAEPTEHGGRTANENNTPSPAEPTENRERTANENKKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNESHPYLNKDGSQKGIHAGQMGENDSFPAWA

SEQ ID NO: 1170 - protein, 557 aa, synthetic construct
  REGION 1..557: note = DSC1 (Q08554) ECD
RWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGR

SEQ ID NO: 1171 - protein, 559 aa, synthetic construct
  REGION 1..559: note = DSC2 (Q02487) ECD
RWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPIFTEETYTFTIFENCRVGTTVGQVCATDKDEPDTMHTRLKYSIIGQVPPSPTLFSMHPTTGVITTTSSQLDRELIDKYQLKIKVQDMDGQYFGLQTTSTCIINIDDVNDHLPTFTRTSYVTSVEENTVDVEILRVTVEDKDLVNTANWRANYTILKGNENGNFKIVTDAKTNEGVLCVVKPLNYEEKQQMILQIGVVNEAPFSREASPRSAMSTATVTVNVEDQDEGPECNPPIQTVRMKENAEVGTTSNGYKAYDPETRSSSGIRYKKLTDPTGWVTIDENTGSIKVFRSLDREAETIKNGIYNITVLASDQGGRTCTGTLGIILQDVNDNSPFIPKKTVIICKPTMSSAEIVAVDPDEPIHGPPFDFSLESSTSEVQRMWRLKAINDTAARLSYQNDPPFGSYVVPITVRDRLGMSSVTSLDVTLCDCITENDCTHRVDPRIGGGGVQLGK

SEQ ID NO: 1172 - protein, 555 aa, synthetic construct
  REGION 1..555: note = DSC3 (Q14574) ECD
RWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVFTEAIYNFEVLESSRPGTTVGVVCATDRDEPDTMHTRLKYSILQQTPRSPGLFSVHPSTGVITTVSHYLDREVVDKYSLIMKVQDMDGQFFGLIGTSTCIITVTDSNDNAPTFRQNAYEAFVEENAFNVEILRIPIEDKDLINTANWRVNFTILKGNENGHFKISTDKETNEGVLSVVKPLNYEENRQVNLEIGVNNEAPFARDIPRVTALNRALVTVHVRDLDEGPECTPAAQYVRIKENLAVGSKINGYKAYDPENRNGNGLRYKKLHDPKGWITIDEISGSIITSKILDREVETPKNELYNITVLAIDKDDRSCTGTLAVNIEDVNDNPPEILQEYVVICKPKMGYTDILAVDPDEPVHGAPFYFSLPNTSPEISRLWSLTKVNDTAARLSYQKNAGFQEYTIPITVKDRAGQAATKLLRVNLCECTHPTQCRATSRSTGVILGK

SEQ ID NO: 1173 - protein, 1578 aa, synthetic construct
  REGION 1..1578: note = DSCAM (O60469) ECD
EDLHSSLYFVNASLQEVVFASTTGTLVPCPAAGIPPVTLRWYLATGEEIYDVPGIRHVHPNGTLQIFPFPPSSFSTLIHDNTYYCTAENPSGKIRSQDVHIKAVLREPYTVRVEDQKTMRGNVAVFKCIIPSSVEAYITVVSWEKDTVSLVSGSRFLITSTGALYIKDVQNEDGLYNYRCITRHRYTGETRQSNSARLFVSDPANSAPSILDGFDHRKAMAGQRVELPCKALGHPEPDYRWLKDNMPLELSGRFQKTVTGLLIENIRPSDSGSYVCEVSNRYGTAKVIGRLYVKQPLKATISPRKVKSSVGSQVSLSCSVTGTEDQELSWYRNGEILNPGKNVRITGINHENLIMDHMVKSDGGAYQCFVRKDKLSAQDYVQVVLEDGTPKIISAFSEKVVSPAEPVSLMCNVKGTPLPTITWTLDDDPILKGGSHRISQMITSEGNVVSYLNISSSQVRDGGVYRCTANNSAGVVLYQARINVRGPASIRPMKNITAIAGRDTYIHCRVIGYPYYSIKWYKNSNLLPFNHRQVAFENNGTLKLSDVQKEVDEGEYTCNVLVQPQLSTSQSVHVTVKVPPFIQPFEFPRFSIGQRVFIPCVVVSGDLPITITWQKDGRPIPGSLGVTIDNIDFTSSLRISNLSLMHNGNYTCIARNEAAAVEHQSQLIVRVPPKFVVQPRDQDGIYGKAVILNCSAEGYPVPTIVWKFSKGAGVPQFQPIALNGRIQVLSNGSLLIKHVVEEDSGYYLCKVSNDVGADVSKSMYLTVKIPAMITSYPNTTLATQGQKKEMSCTAHGEKPIIVRWEKEDRIINPEMARYLVSTKEVGEEVISTLQILPTVREDSGFFSCHAINSYGEDRGIIQLTVQEPPDPPEIEIKDVKARTITLRWTMGFDGNSPITGYDIECKNKSDSWDSAQRTKDVSPQLNSATIIDIHPSSTYSIRMYAKNRIGKSEPSNELTITADEAAPDGPPQEVHLEPISSQSIRVTWKAPKKHLQNGIIRGYQIGYREYSTGGNFQFNIISVDTSGDSEVYTLDNLNKFTQYGLVVQACNRAGTGPSSQEIITTTLEDVPSYPPENVQAIATSPESISISWSTLSKEALNGILQGFRVIYWANLMDGELGEIKNITTTQPSLELDGLEKYTNYSIQVLAFTRAGDGVRSEQIFTRTKEDVPGPPAGVKAAAASASMVFVSWLPPLKLNGIIRKYTVFCSHPYPTVISEFEASPDSFSYRIPNLSRNRQYSVWVVAVTSAGRGNSSEIITVEPLAKAPARILTFSGTVTTPWMKDIVLPCKAVGDPSPAVKWMKDSNGTPSLVTIDGRRSIFSNGSFIIRTVKAEDSGYYSCIANNNWGSDEIILNLQVQVPPDQPRLTVSKTTSSSITLSWLPGDNGGSSIRGYILQYSEDNSEQWGSFPISPSERSYRLENLKCGTWYKFTLTAQNGVGPGRISEIIEAKTLGKEPQFSKEQELFASINTTRVRLNLIGWNDGGCPITSFTLEYRPFGTTVWTTAQRTSLSKSYILYDLQEATWYELQMRVCNSAGCAEKQANFATLNYDGSTIPPLIKSVVQNEEGLTTNEGLKM

SEQ ID NO: 1174 - protein, 1573 aa, synthetic construct
  REGION 1..1573: note = DSCAML1 (Q8TD84) ECD
EDVGTSLYFVNDSLQQVTFSSSVGVVVPCPAAGSPSAALRWYLATGDDIYDVPHIRHVHANGTLQLYPFSPSAFNSFIHDNDYFCTAENAAGKIRSPNIRVKAVFREPYTVRVEDQRSMRGNVAVFKCLIPSSVQEYVSVVSWEKDTVSIIPEHRFFITYHGGLYISDVQKEDALSTYRCITKHKYSGETRQSNGARLSVTDPAESIPTILDGFHSQEVWAGHTVELPCTASGYPIPAIRWLKDGRPLPADSRWTKRITGLTISDLRTEDSGTYICEVTNTFGSAEATGILMVIDPLHVTLTPKKLKTGIGSTVILSCALTGSPEFTIRWYRNTELVLPDEAISIRGLSNETLLITSAQKSHSGAYQCFATRKAQTAQDFAIIALEDGTPRIVSSFSEKVVNPGEQFSLMCAAKGAPPPTVTWALDDEPIVRDGSHRTNQYTMSDGTTISHMNVTGPQIRDGGVYRCTARNLVGSAEYQARINVRGPPSIRAMRNITAVAGRDTLINCRVIGYPYYSIKWYKDALLLPDNHRQVVFENGTLKLTDVQKGMDEGEYLCSVLIQPQLSISQSVHVAVKVPPLIQPFEFPPASIGQLLYIPCVVSSGDMPIRITWRKDGQVIISGSGVTIESKEFMSSLQISSVSLKHNGNYTCIASNAAATVSRERQLIVRVPPRFVVQPNNQDGIYGKAGVLNCSVDGYPPPKVMWKHAKGSGNPQQYHPVPLTGRIQILPNSSLLIRHVLEEDIGYYLCQASNGVGTDISKSMFLTVKIPAMITSHPNTTIAIKGHAKELNCTARGERPIIIRWEKGDTVIDPDRVMRYAIATKDNGDEVVSTLKLKPADRGDSVFFSCHAINSYGEDRGLIQLTVQEPPDPPELEIREVKARSMNLRWTQRFDGNSIITGFDIEYKNKSDSWDFKQSTRNISPTINQANIVDLHPASVYSIRMYSFNKIGRSEPSKELTISTEEAAPDGPPMDVTLQPVTSQSIQVTWKAPKKELQNGVIRGYQIGYRENSPGSNGQYSIVEMKATGDSEVYTLDNLKKFAQYGVVVQAFNRAGTGPSSSEINATTLEDVPSQPPENVRALSITSDVAVISWSEPPRSTLNGVLKGYRVIFWSLYVDGEWGEMQNITTTRERVELRGMEKFTNYSVQVLAYTQAGDGVRSSVLYIQTKEDVPGPPAGIKAVPSSASSVVVSWLPPTKPNGVIRKYTIFCSSPGSGQPAPSEYETSPEQLFYRIAHLNRGQQYLLWVAAVTSAGRGNSSEKVTIEPAGKAPAKIISFGGTVTTPWMKDVRLPCNSVGDPAPAVKWTKDSEDSAIPVSMDGHRLIHTNGTLLLRAVKAEDSGYYTCTATNTGGFDTIIVNLLVQVPPDQPRLTVSKTSASSITLTWIPGDNGGSSIRGFVLQYSVDNSEEWKDVFISSSERSFKLDSLKCGTWYKVKLAAKNSVGSGRISEIIEAKTHGREPSFSKDQHLFTHINSTHARLNLQGWNNGGCPITAIVLEYRPKGTWAWQGLRANSSGEVFLTELREATWYELRMRACNSAGCGNETAQFATLDYDGSTIPPIKSAQGEGDDVKK

SEQ ID NO: 1175 - protein, 499 aa, synthetic construct
  REGION 1..499: note = DSG1 (Q02413) ECD
EWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVFSMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYMEQSSYTIEIQENTLNSNLLEIRVIDLDEEFSANWMAVIFFISGNEGNWFEIEMNERTNVGILKVVKPLDYEAMQSLQLSIGVRNKAEFHHSIMSQYKLKASAISVTVLNVIEGPVFRPGSKTYVVTGNMGSNDKVGDFVATDLDTGRPSTTVRYVMGNNPADLLAVDSRTGKLTLKNKVTKEQYNMLGGKYQGTILSIDDNLQRTCTGTININIQSFGNDDRTNTEPNTKITTNTGRQESTSSTNYDTSTTSTDSSQVYSSEPGNGAKDLLSDNVHFGP

SEQ ID NO: 1176 - protein, 560 aa, synthetic construct
  REGION 1..560: note = DSG2 (Q14126) ECD
AWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVG

SEQ ID NO: 1177 - protein, 566 aa, synthetic construct
  REGION 1..566: note = DSG3 (P32926) ECD
EWVKFAKPCREGEDNSKRNPIAKITSDYQATQKITYRISGVGIDQPPFGIFVVDKNTGDINITAIVDREETPSFLITCRALNAQGLDVEKPLILTVKILDINDNPPVFSQQIFMGEIEENSASNSLVMILNATDADEPNHLNSKIAFKIVSQEPAGTPMFLLSRNTGEVRTLTNSLDREQASSYRLVVSGADKDGEGLSTQCECNIKVKDVNDNFPMFRDSQYSARIEENILSSELLRFQVTDLDEEYTDNWLAVYFFTSGNEGNWFEIQTDPRTNEGILKVVKALDYEQLQSVKLSIAVKNKAEFHQSVISRYRVQSTPVTIQVINVREGIAFRPASKTFTVQKGISSKKLVDYILGTYQAIDEDTNKAASNVKYVMGRNDGGYLMIDSKTAEIKFVKNMNRDSTFIVNKTITAEVLAIDEYTGKTSTGTVYVRVPDFNDNCPTAVLEKDAVCSSSPSVVVSARTLNNRYTGPYTFALEDQPVKLPAVWSITTLNATSALLRAQEQIPPGVYHISLVLTDSQNNRCEMPRSLTLEVCQCDNRGICGTSYPTTSPGTRYGRPHSGR

SEQ ID NO: 1178 - protein, 582 aa, synthetic construct
  REGION 1..582: note = DSG4 (Q86SJ6) ECD
EWIKFAAACREGEDNSKRNPIAKIRSDCESNQKITYRISGVGIDRPPYGVFTINPRTGEINITSVVDREITPLFLIYCRALNSRGEDLERPLELRVKVMDINDNAPVFSQSVYTASIEENSDANTLVVKLCATDADEENHLNSKIAYKIVSQEPSGAPMFILNRYTGEVCTMSSFLDREQHSMYNLVVRGSDRDGAADGLSSECDCRIKVLDVNDNFPTLEKTSYSASIEENCLSSELIRLQAIDLDEEGTDNWLAQYLILSGNDGNWFDIQTDPQTNEGILKVVKMLDYEQAPNIQLSIGVKNQADFHYSVASQFQMHPTPVRIQVVDVREGPAFHPSTMAFSVREGIKGSSLLNYVLGTYTAIDLDTGNPATDVRYIIGHDAGSWLKIDSRTGEIQFSREFDKKSKYIINGIYTAEILAIDDGSGKTATGTICIEVPDINDYCPNIFPERRTICIDSPSVLISVNEHSYGSPFTFCVVDEPPGIADMWDVRSTNATSAILTAKQVLSPGFYEIPILVKDSYNRACELAQMVQLYACDCDDNHMCLDSGAAGIYTEDITGDTYGPVTEDQAGVSNVGLGPA

SEQ ID NO: 1179 - protein, 100 aa, synthetic construct
  REGION 1..100: note = ECSCR (Q19T08) ECD
QPTMTQTSSSQGGLGGLSLTTEPVSSNPGYIPSSEANRPSHLSSTGTPGAGVPSSGRDGGTSRDTFQTVPPNSTTMSLSMREDATILPSPTSETVLTVAA

SEQ ID NO: 1180 - protein, 161 aa, synthetic construct
  REGION 1..161: note = EDAR (Q9UNE0) ECD
EYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATA

SEQ ID NO: 1181 - protein, 210 aa, synthetic construct
  REGION 1..210: note = EFNB1 (P98172) ECD
LAKNLEPVSWSSLNPKFLSGKGLVIYPKIGDKLDIICPRAEAGRPYEYYKLYLVRPEQAAACSTVLDPNVLVTCNRPEQEIRFTIKFQEFSPNYMGLEFKKHHDYYITSTSNGSLEGLENREGGVCRTRTMKIIMKVGQDPNAVTPEQLTTSRPSKEADNTVKMATQAPGSRGSLGDSDGKHETVNQEEKSGPGASGGSSGDPDGFFNSK

SEQ ID NO: 1182 - protein, 202 aa, synthetic construct
  REGION 1..202: note = EFNB2 (P52799) ECD
IVLEPIYWNSSNSKFLPGQGLVLYPQIGDKLDIICPKVDSKTVGQYEYYKVYMVDKDQADRCTIKKENTPLLNCAKPDQDIKFTIKFQEFSPNLWGLEFQKNKDYYIISTSNGSLEGLDNQEGGVCQTRAMKILMKVGQDASSAGSTRNKDPTRRPELEAGTNGRSSTTSPFVKPNPGSSTDGNSAGHSGNNILGSEVALFA

SEQ ID NO: 1183 - protein, 199 aa, synthetic construct
  REGION 1..199: note = EFNB3 (Q15768) ECD
LSLEPVYWNSANKRFQAEGGYVLYPQIGDRLDLLCPRARPPGPHSSPNYEFYKLYLVGGAQGRRCEAPPAPNLLLTCDRPDLDLRFTIKFQEYSPNLWGHEFRSHHDYYIIATSDGTREGLESLQGGVCLTRGMKVLLRVGQSPRGGAVPRKPVSEMPMERDRGAAHSLEPGKENLPGDPTSNATSRGAEGPLPPPSMP

SEQ ID NO: 1184 - protein, 1010 aa, synthetic construct
  REGION 1..1010: note = EGF (P01133) ECD
PQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQK

SEQ ID NO: 1185 - protein, 621 aa, synthetic construct [sequence omitted]

SEQ ID NO: 1186 - protein, 391 aa, synthetic construct
  REGION 1..391: note = ELFN1 (P0C7U0) ECD
DCWLIEGDKGFVWLAICSQNQPPYEAIPQQINSTIVDLRLNENRIRSVQYASLSRFGNLTYLNLTKNEIGYIEDGAFSGQFNLQVLQLGYNRLRNLTEGMLRGLGKLEYLYLQANLIEVVMASSFWECPNIVNIDLSMNRIQQLNSGTFAGLAKLSVCELYSNPFYCSCELLGFLRWLAAFTNATQTYDRMQCESPPVYSGYYLLGQGRRGHRSILSKLQSVCTEDSYAAEVVGPPRPASGRSQPGRSPPPPPPPEPSDMPCADDECFSGDGTTPLVALPTLATQAEARPLIKVKQLTQNSATITVQLPSPFHRMYTLEHFNNSKASTVSRLTKAQEEIRLTNLFTLTNYTYCVVSTSAGLRHNHTCLTICLPRLPSPPGPVPSPSTATHY

SEQ ID NO: 1187 - protein, 375 aa, synthetic construct
  REGION 1..375: note = ELFN2 (Q5R3F8) ECD
DCWLIEGDKGYVWLAICSQNQPPYETIPQHINSTVHDLRLNENKLKAVLYSSLNRFGNLTDLNLTKNEISYIEDGAFLGQSSLQVLQLGYNKLSNLTEGMLRGMSRLQFLFVQHNLIEVVTPTAFSECPSLISIDLSSNRLSRLDGATFASLASLMVCELAGNPFNCECDLFGFLAWLVVFNNVTKNYDRLQCESPREFAGYPLLVPRPYHSLNAITVLQAKCRNGSLPARPVSHPTPYSTDAQREPDENSGFNPDEILSVEPPASSTTDASAGPAIKLHHVTFTSATLVVIIPHPYSKMYILVQYNNSYFSDVMTLKNKKEIVTLDKLRAHTEYTFCVTSLRNSRRFNHTCLTFTTRDPVPGDLAPSTSTTTHY

SEQ ID NO: 1188 - protein, 228 aa, synthetic construct
  REGION 1..228: note = EMB (Q6PCB8) ECD
DGSAPDSPFTSPPLREEIMANNFSLESHNISLTEHSSMPVEKNITLERPSNVNLTCQFTTSGDLNAVNVTWKKDGEQLENNYLVSATGSTLYTQYRFTIINSKQMGSYSCFFREEKEQRGTFNFKVPELHGKNKPLISYVGDSTVLTCKCQNCFPLNWTWYSSNGSVKVPVGVQMNKYVINGTYANETKLKITQLLEEDGESYWCRALFQLGESEEHIELVVLSYLVP

SEQ ID NO: 1189 - protein, 172 aa, synthetic construct
  REGION 1..172: note = EMCN (Q9ULC0) ECD
NSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGSVLQPDASPSKTGTLTSIPVTIPENTSQSQVIGTEGGKNASTSATSRSYSS

SEQ ID NO: 1190 - protein, 561 aa, synthetic construct
  REGION 1..561: note = ENG (P17813) ECD
ETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKG

SEQ ID NO: 1191 - protein, 392 aa, synthetic construct
  REGION 1..392: note = ENPP4 (Q9Y6X5) ECD
FRSDSSSSLPPKLLLVSFDGFRADYLKNYEFPHLQNFIKEGVLVEHVKNVFITKTFPNHYSIVTGLYEESHGIVANSMYDAVTKKHFSDSNDKDPFWWNEAVPIWVTNQLQENRSSAAAMWPGTDVPIHDTISSYFMNYNSSVSFEERLNNITMWLNNSNPPVTFATLYWEEPDASGHKYGPEDKENMSRVLKKIDDLIGDLVQRLKMLGLWENLNVIITSDHGMTQCSQDRLINLDSCIDHSYYTLIDLSPVAAILPKINRTEVYNKLKNCSPHMNVYLKEDIPNRFYYQHNDRIQPIILVADEGWTIVLNESSQKLGDHGYDNSLPSMHPFLAAHGPAFHKGYKHSTINIVDIYPMMCHILGLKPHPNNGTFGHTKCLLVDQWCINLPEA

SEQ ID NO: 1192 - protein, 407 aa, synthetic construct
  REGION 1..407: note = ENPP5 (Q9UJA9) ECD
PDQQKVLLVSFDGFRWDYLYKVPTPHFHYIMKYGVHVKQVTNVFITKTYPNHYTLVTGLFAENHGIVANDMFDPIRNKSFSLDHMNIYDSKFWEEATPIWITNQRAGHTSGAAMWPGTDVKIHKRFPTHYMPYNESVSFEDRVAKIIEWFTSKEPINLGLLYWEDPDDMGHHLGPDSPLMGPVISDIDKKLGYLIQMLKKAKLWNTLNLIITSDHGMTQCSEERLIELDQYLDKDHYTLIDQSPVAAILPKEGKFDEVYEALTHAHPNLTVYKKEDVPERWHYKYNSRIQPIIAVADEGWHILQNKSDDFLLGNHGYDNALADMHPIFLAHGPAFRKNFSKEAMNSTDLYPLLCHLLNITAMPHNGSFWNVQDLLNSAMPRVVPYTQSTILLPGSVKPAEYDQEGSY

SEQ ID NO: 1193 - protein, 242 aa, synthetic construct
  REGION 1..242: note = EPCAM (P16422) ECD
QEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLK

SEQ ID NO: 1194 - protein, 88 aa, synthetic construct
  REGION 1..88: note = EPGN (Q6UW88) ECD
AAVTVTPPITAQQGNWTVNKTEADNIEGPIALKFSHLCLEDHNSYCINGACAFHHELEKAICRCFTGYTGERCEHLTLTSYAVDSYEK

SEQ ID NO: 1195 - protein, 522 aa, synthetic construct
  REGION 1..522: note = EPHA1 (P21709) ECD
KEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLVSGSVKLNVERCSLGRLTRRGLYLAFHNPGACVALVSVRVFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGE

SEQ ID NO: 1196 - protein, 532 aa, synthetic construct
  REGION 1..532: note = EPHA10 (Q5JZY3) ECD
EEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEACPPGFYKVSPRRPLCSPCPEHSRALENASTFCVCQDSYARSPTDPPSASCTRPPSAPRDLQYSLSRSPLVLRLRWLPPADSGGRSDVTYSLLCLRCGREGPAGACEPCGPRVAFLPRQAGLRERAATLLHLRPGARYTVRVAALNGVSGPAAAAGTTYAQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPA

SEQ ID NO: 1197 - protein, 514 aa, synthetic construct
  REGION 1..514: note = EPHA2 (P29317) ECD
AQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAV

SEQ ID NO: 1198 - protein, 521 aa, synthetic construct
  REGION 1..521: note = EPHA3 (P29320) ECD
ELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQ

SEQ ID NO: 1199 - protein, 528 aa, synthetic construct
  REGION 1..528: note = EPHA4 (P54764) ECD
VTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANST

SEQ ID NO: 1200 - protein, 549 aa, synthetic construct
  REGION 1..549: note = EPHA5 (P54756) ECD
PASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVFAASSDQSQIP

SEQ ID NO: 1201 - protein, 528 aa, synthetic construct
  REGION 1..528: note = EPHA6 (Q9UF33) ECD
WPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHACRPGFYKAFAGNTKCSKCPPHSLTYMEATSVCQCEKGYFRAEKDPPSMACTRPPSAPRNVVFNINETALILEWSPPSDTGGRKDLTYSVICKKCGLDTSQCEDCGGGLRFIPRHTGLINNSVIVLDFVSHVNYTFEIEAMNGVSELSFSPKPFTAITVTTDQDAPSLIGVVRKDWASQNSIALSWQAPAFSNGAILDYEIKYYEKEHEQLTYSSTRSKAPSVIITGLKPATKYVFHIRVRTATGYSGYSQKFEFETGDETSDMAAEQGQILV

SEQ ID NO: 1202 - protein, 528 aa, synthetic construct
  REGION 1..528: note = EPHA7 (Q15375) ECD
QAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPV

SEQ ID NO: 1203 - protein, 515 aa, synthetic construct
  REGION 1..515: note = EPHA8 (P29322) ECD
ARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAAPSQVVVIRQERAGQTSVSLLWQEPEQPNGIILEYEIKYYEKDKEMQSYSTLKAVTTRATVSGLKPGTRYVFQVRARTSAGCGRFSQAMEVETGKPRPRYDTRT

SEQ ID NO: 1204 - protein, 523 aa, synthetic construct
  REGION 1..523: note = EPHB1 (P54762) ECD
MEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPAEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLP

SEQ ID NO: 1205 - protein, 525 aa, synthetic construct
  REGION 1..525: note = EPHB2 (P29323) ECD
VEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPL

SEQ ID NO: 1206 - protein, 526 aa, synthetic construct
  REGION 1..526: note = EPHB3 (P54753) ECD
GCRALEETLMDTKWVTSELAWTSHPESGWEEVSGYDEAMNPIRTYQVCNVRESSQNNWLRTGFIWRRDVQRVYVELKFTVRDCNSIPNIPGSCKETFNLFYYEADSDVASASSPFWMENPYVKVDTIAPDESFSRLDAGRVNTKVRSFGPLSKAGFYLAFQDQGACMSLISVRAFYKKCASTTAGFALFPETLTGAEPTSLVIAPGTCIPNAVEVSVPLKLYCNGDGEWMVPVGACTCATGHEPAAKESQCRPCPPGSYKAKQGEGPCLPCPPNSRTTSPAASICTCHNNFYRADSDSADSACTTVPSPPRGVISNVNETSLILEWSEPRDLGGRDDLLYNVICKKCHGAGGASACSRCDDNVEFVPRQLGLTERRVHISHLLAHTRYTFEVQAVNGVSGKSPLPPRYAAVNITTNQAAPSEVPTLRLHSSSGSSLTLSWAPPERPNGVILDYEMKYFEKSEGIASTVTSQMNSVQLDGLRPDARYVVQVRARTVAGYGQYSRPAEFETTSERGSGAQQLQEQLPL

SEQ ID NO: 1207 - protein, 524 aa, synthetic construct
  REGION 1..524: note = EPHB4 (P54760) ECD
LEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLA

SEQ ID NO: 1208 - protein, 563 aa, synthetic construct
  REGION 1..563: note = EPHB6 (O15197) ECD
LEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKVDTIAADESFPSSSSSSSSSSSAAWAVGPHGAGQRAGLQLNVKERSFGPLTQRGFYVAFQDTGACLALVAVRLFSYTCPAVLRSFASFPETQASGAGGASLVAAVGTCVAHAEPEEDGVGGQAGGSPPRLHCNGEGKWMVAVGGCRCQPGYQPARGDKACQACPRGLYKSSAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLS

SEQ ID NO: 1209 - protein, 226 aa, synthetic construct
  REGION 1..226: note = EPOR (P19235) ECD
APPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDP

SEQ ID NO: 1210 - protein, 167 aa, synthetic construct
  REGION 1..167: note = EQTN (Q9NQ60) ECD
LKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQRSTPNVPAFWTMLAKAINGTAVVMDDKDQLFHPIPESDVNATQGENQPDLEDLKIK

SEQ ID NO: 1211 - protein, 630 aa, synthetic construct
  REGION 1..630: note = ERBB2 (P04626) ECD
TQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLT

SEQ ID NO: 1212 - protein, 624 aa, synthetic construct
  REGION 1..624: note = ERBB3 (P21860) ECD
SEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLT

SEQ ID NO: 1213 - protein, 626 aa, synthetic construct
  REGION 1..626: note = ERBB4 (Q15303) ECD
QSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTP

SEQ ID NO: 1214 - protein, 60 aa, synthetic construct
  REGION 1..60: note = EREG (O14944) ECD
VAQVSITKCSSDMNGYCLHGQCIYLVDMSQNYCRCEVGYTGVRCEHFFLTVHQPLSKEYV

SEQ ID NO: 1215 - protein, 126 aa, synthetic construct
  REGION 1..126: note = ERMAP (Q96PL5) ECD
HAGDAGKFHVALLGGTAELLCPLSLWPGTVPKEVRWLRSPFPQRSQAVHIFRDGKDQDEDLMPEYKGRTVLVRDAQEGSVTLQILDVRLEDQGSYRCLIQVGNLSKEDTVILQVAAPSVGSLSPSA

SEQ ID NO: 1216 - protein, 496 aa, synthetic construct
  REGION 1..496: note = ERVFC1 (P60507) ECD
NSLLTEPPFRWRFYLHETWTQGNRLSTVTLATVDCQPHGCQAQVTFNFTSFKSVLRGWSNPTICFVYDQTHSNCRDYWVDTNGGCPYAYCRMHVTQLHTAKKLQHTYRLTSDGRTTYFLTIPDPWDSRWVSGVTGRLYRWPTDSYPVGKLRIFLTYIRVIPQVLSNLKDQADNIKHQEEVINTLVQSHPKADMVTYDDKAEAGPFSWITLVRHGARLVNMAGLVNLSHCFLCTALSQPPLVAVPLPQAFNTSGNHTAHPSGVFSEQVPLFRDPLQPQFPFCYTTPNSSWCNQTYSGSLSNLSAPAGGYFWCNFTLTKHLNISSNNTLSRNLCLPISLVPRLTLYSEAELSSLVNPPMRQKRAVFPPLVIGVSLTSSLVASGLGTGAIVHFISSSQDLSIKLQMAIEASAESLASLQRQITSVAKVAMQNRRALDLLTADKGGTCMFLGEECCYYINESGLVETSLLTLDKIRDGLHRPSSTPNYGGGWWQSPLTTW

SEQ ID NO: 1217 - protein, 496 aa, synthetic construct; identical to SEQ ID NO: 1216
  REGION 1..496: note = ERVFRD-1 (P60508) ECD

SEQ ID NO: 1218 - protein, 543 aa, synthetic construct
  REGION 1..543: note = ERVK-19 (O71037) ECD
LPMPAGAAAANYTYWAYVPFPPLIRAVTWMDNPIEVYVNDSVWVPGPTDDHCPAKPEEEGMMINISIGYRYPPICLGRAPGCLMPAVQNWLVEVPTVSPISRFTYHMVSGMSLRPRVNYLQDFSYQRSFKFRPKGKPCPKEIPKESKNTEVLVWEECVANSAVILQNNEFGTIIDWAPRGQFYHNCSGQTQSCPSAQVSPAVDSDLTESLDKHKHKKLQSFYPWEWGEKGISTPRPKIISPVSGPEHPELWRLTVASHHIRIWSGNQTLETRDRKPFYTVDLNSSVTVPLQSCIKPPYMLVVGNIVIKPDSQTITCENCRLLTCIDSTFNWQHRILLVRAREGVWIPVSMDRPWETSPSIHTLTEVLKGVLNRSKRFIFTLIAVIMGLIAVTATAAVAGVALHSSVQSVNFVNDWQKNSTRLWNSQSSIDQKLANQINDLRQTVIWMGDRLMSLEHRFQLQCDWNTSDFSITPQIYNESEHHWDMVRRHLQGREDNLTLDISKLKEQIFEASKAHLNLVPGTEAIAGVADGLANLNPVTWVKT

SEQ ID NO: 1219 - protein, 543 aa, synthetic construct
  REGION 1..543: note = ERVK-21 (P61565) ECD
LPMPAGAAAANYTNWAYVPFPPLIRAVTWMDNPIEVYVNDSVWVHGPIDDRCPAKPEEEGMMINISIGYHYPPICLGRAPGCLMPAVQNWLVEVPTVSPISRFTYNMVSGMSLRPRVNYLQDFSYQRSLKFRPKGKPCPKEIPKESKNTEVLVWEECVANSVVILQNNEFGTIIDWAPRGQFYHNCSGQTQSCPSAQVSPAVDSDLTESLDKHKHKKLQSFYPWEWGEKGISTPRPKIISPVSGPEHPELWRLTVASHHIRIWSGNQTLETRDRKPFYTVDLNSSLTVPLQSCVKPPYMLVVGNIVIKPDSQTITCENCRLLTCIDSTFNWQHRILLVRAREGVWIPVSMDRPWEASPSIHILTEVLKGVLNRSKRFIFTLIAVIMGLIAVTAMAAVAGVALHSFVQSVNFVNDWQKNSTRLWNSQSSIDQKLANQINDLRQTVIWMGDRLMSLEHRFQLQCDWNTSDFCITPQIYNESEHHWDMVRRHLQGREDNLTLDISKLKEQIFEASKAHLNLVPGTEAIAGVADGLANLNPVTWVKT

SEQ ID NO: 1220 - protein, 543 aa, synthetic construct
  REGION 1..543: note = ERVK-6 (Q69384) ECD
LPMPAGAAAANYTYWAYVPFPPLIRAVTWMDNPTEVYVNDSVWVPGPIDDRCPAKPEEEGMMINISIGYHYPPICLGRAPGCLMPAVQNWLVEVPTVSPICRFTYHMVSGMSLRPRVNYLQDFSYQRSLKFRPKGKPCPKEIPKESKNTEVLVWEECVANSAVILQNNEFGTIIDWAPRGQFYHNCSGQTQSCPSAQVSPAVDSDLTESLDKHKHKKLQSFYPWEWGEKGISTPRPKIVSPVSGPEHPELWRLTVASHHIRIWSGNQTLETRDRKPFYTIDLNSSLTVPLQSCVKPPYMLVVGNIVIKPDSQTITCENCRLLTCIDSTFNWQHRILLVRAREGVWIPVSMDRPWEASPSVHILTEVLKGVLNRSKRFIFTLIAVIMGLIAVTATAAVAGVALHSSVQSVNFVNDWQKNSTRLWNSQSSIDQKLANQINDLRQTVIWMGDRLMSLEHRFQLQCDWNTSDFCITPQIYNESEHHWDMVRRHLQGREDNLTLDISKLKEQIFEASKAHLNLVPGTEAIAGVADGLANLNPVTWVKT

SEQ ID NO: 1221 - protein, 543 aa, synthetic construct
  REGION 1..543: note = ERVK-8 (Q902F8) ECD
LPMPAGAAVANYTNWAYVPFPPLIRAVTWMDNPIEVYVNDSVWVPGPIDDRCPAKPEEEGMMINISIGYRYPPICLGRAPGCLMPAVQNWLVEVPTVSPISRFTYHMVSGMSLRPRVNYLQDFSYQRSLKFRPKGKPCPKEIPKESKNTEVLVWEECVANSAVILQNNEFGTIIDWAPRGQFYHNCSGQTQSCPSAQVSPAVDSDLTESLDKHKHKKLQSFYPWEWGEKRISTPRPKIVSPVSGPEHPELWRLTVASHHIRIWSGNQTLETRDRKPFYTVDLNSSLTLPLQSCVKPPYMLVVGNIVIKPDSQTITCENCRLLTCIDSTFNWQHRILLVRAREGVWIPVSMDRPWEASPSVHILTEVLKGVLNRSKRFIFTLIAVIMGLIAVTATAAVAGVALHSSVQSVNFVNDGQKNSTRLWNSQSSIDQKLANQINDLRQTVIWMGDRLMSLEHRFQLQCDWNTSDFCITPQIYNDSEHHWDMVRRHLQGREDNLTLDISKLKEQIFEASKAHLNLVPGTEAIAGVADGLANLNPVTWVKT

SEQ ID NO: 1222 - protein, 542 aa, synthetic construct
  REGION 1..542: note = ERVK-9 (Q9UKH3) ECD
LPMPAGAAAANYTNWAYVPFPPLIRAVTWMDNPIEVYVNDSVWVPGPIDDRCPAKPEEEGMMINISIGYRYPICLGRAPGCLMPAVQNWLVEVPIVSPICRFTYHMVSGMSLRPRVNYLQDFSYQRSLKFRPKGKPCPKEIPKESKNTEVLVWEECVANSAVILQNNEFGTIIDWTPQGQFYHNCSGQTQSCPSAQVSPAVDSDLTESLDKHKHKKLQSFYPWEWGEKGISTPRPKIISPVSGPEHPELWRLTVASHHIRIWSGNQTLETRDRKPFYTVDLNSSLTLPLQSCVKPPYMLVVGNIVIKPDSQTITCENCRLLTCIDSTFNWQHRILLVRAREGVWIPVSMDRPWEASPSIHILTEVLKGVLNRSKRFIFTLIAVIMGLIAVTATAAVAGVALHSSVQSVNFVNDGQKNSTRLWNSQSSIDQKLANQINDLRQTVIWMGDRLMSLEHRFQLQCDWNTSDFCITPQIYNESEHHWDMVRRHLQGREDNLTLDISKLKEQIFEASKAHLNLVPGTEAIAGVADGLANLNPVTWVKT

SEQ ID NO: 1223 - protein, 462 aa, synthetic construct
  REGION 1..462: note = ERVMER34-1 (Q9H9K5) ECD
LLAPVFRTLSILTNQSNCWLCEHLDNAEQPELVFVPASASTWWTYSGQWMYERVWYPQAEVQNHSTSSYRKVTWHWEASMEAQGLSFAQVRLLEGNFSLCVENKNGSGPFLGNIPKQYCNQILWFDSTDGTFMPSIDVTNESRNDDDDTSVCLGTRQCSWFAGCTNRTWNSSAVPLIGLPNTQDYKWVDRNSGLTWSGNDTCLYSCQNQTKGLLYQLFRNLFCSYGLTEAHGKWRCADASITNDKGHDGHRTPTWWLTGSNLTLSVNNSGLFFLCGNGVYKGFPPKWSGRCGLGYLVPSLTRYLTLNASQITNLRSFIHKVTPHRCTQGDTDNPPLYCNPKDNSTIRALFPSLGTYDLEKAILNISKAMEQEFSATKQTLEAHQSKVSSLASASRKDHVLDIPTTQRQTACGTVGKQCCLYINYSEEIKSNIQRLHEASENLKNVPLLDWQGIFAKVGDWFR

SEQ ID NO: 1224 - protein, 451 aa, synthetic construct
  REGION 1..451: note = ERVPABLB-1 (P60509) ECD
MDPLHTIEKVPARRNIHDRGHQGHRMGDGTPGRPKISVQQMTRFSLIIFFLSAPFVVNASTSNVFLQWAHSYADGLQQGDPCWVCGSLPVTNTMELPWWVSPLQGKDWVFFQSFIGDLKQWTGAQMTGVTRKNISEWPINKTLNEPGHDKPFSVNETRDKVIAFAIPLLDTKVFVQTSRPQNTQYRNGFLQIWDGFIWLTATKGHLSQIAPLCWEQRNHSLDNWPNTTRVMGWIPPGQCRHTILLQQRDLFATDWSQQPGLNWYAPNGTQWLCSPNLWPWLPSGWLGCCTLGIPWAQGRWVKTMEVYPYLPHVVNQGTRAIVHRNDHLPTIFMPSVGLGTVIQHIEALANFTQRALNDSLQSISLMNAEVYYMHEDILQNRMALDILTAAEGGTCALIKTECCVYIPNNSRNISLALEDTCRQIQVISSSALSLHDWIASQFSGRPSWWQK

SEQ ID NO: 1225 - protein, 537 aa, synthetic construct
  REGION 1..537: note = ERVS71-1 (P61550) ECD
EPSYSFLLTSFTTGRVFANTTWRAGTSKEVSFAVDLCVLFPEPARTHEEQHNLPVIGAGSVDLAAGFGHSGSQTGCGSSKGAEKGLQNVDFYLCPGNHPDASCRDTYQFFCPDWTCVTLATYSGGSTRSSTLSISRVPHPKLCTRKNCNPLTITVHDPNAAQWYYGMSWGLRLYIPGFDVGTMFTIQKKILVSWSSPKPIGPLTDLGDPIFQKHPDKVDLTVPLPFLVPRPQLQQQHLQPSLMSILGGVHHLLNLTQPKLAQDCWLCLKAKPPYYVGLGVEATLKRGPLSCHTRPRALTIGDVSGNASCLISTGYNLSASPFQATCNQSLLTSISTSVSYQAPNNTWLACTSGLTRCINGTEPGPLLCVLVHVLPQVYVYSGPEGRQLIAPPELHPRLHQAVPLLVPLLAGLSIAGSAAIGTAALVQGETGLISLSQQVDADFSNLQSAIDILHSQVESLAEVVLQNCRCLDLLFLSQGGLCAALGESCCFYANQSGVIKGTVKKVRENLDRHQQERENNIPWYQSMFNWNPWLTTL

SEQ ID NO: 1226 - protein, 300 aa, synthetic construct
  REGION 1..300: note = ERVV-1 (B6SEH8) ECD
QWNENSLVSFSKIIASGNHLSNCWICHNFITRSSSYQYILVRNFSLNLTFGSGIPEGQHKSVPLQVSLANSAHQVPCLDLTPPFNQSSKTSFYFYNCSSLNQTCCPCPEGHCDRKNTSEEGFPSPTIHPMSFSPAGCHPNLTHWCPAKQMNDYRDKSPQNRCAAWEGKELITWRVLYLLPKAHTVPTWPKSTVPLGGPLSPACNQTIPAGWKSQLHKWFDSHIPRWACTPPGYVFLCGPQKNKLPFDGSPKITYSTPPVANLYTCINNIQHTGECAVGLLGPRGIGVTIYNTTQPRQKRA

SEQ ID NO: 1227 - protein, 423 aa, synthetic construct
  REGION 1..423: note = ERVW-1 (Q9UQF0) ECD
APPPCRCMTSSSPYQEFLWRMQRPGNIDAPSYRSLSKGTPTFTAHTHMPRNCYHSATLCMHANTHYWTGKMINPSCPGGLGVTVCWTYFTQTGMSDGGGVQDQAREKHVKEVISQLTRVHGTSSPYKGLDLSKLHETLRTHTRLVSLFNTTLTGLHEVSAQNPTNCWICLPLNFRPYVSIPVPEQWNNFSTEINTTSVLVGPLVSNLEITHTSNLTCVKFSNTTYTTNSQCIRWVTPPTQIVCLPSGIFFVCGTSAYRCLNGSSESMCFLSFLVPPMTIYTEQDLYSYVISKPRNKRVPILPFVIGAGVLGALGTGIGGITTSTQFYYKLSQELNGDMERVADSLVTLQDQLNSLAAVVLQNRRALDLLTAERGGTCLFLGEECCYYVNQSGIVTEKVKEIRDRIQRRAEELRNTGPWGLLSQ

SEQ ID NO: 1228 - protein, 219 aa, synthetic construct
  REGION 1..219: note = ESAM (Q96AP7) ECD
QLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAA

SEQ ID NO: 1229 - protein, 274 aa, synthetic construct
  REGION 1..274: note = EVA1C (P58658) ECD
LTDFSGYLTKLLQNHTTYACDGDYLNLQCPRHSTISVQSAFYGQDYQMCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPGVKKYLTVTYACVPKNILTAIDPAIANLKPSLKQKDGEYGINFDPSGSKVLRKDGILVSNSLAAFAYIRAHPERA

SEQ ID NO: 1230 - protein, 274 aa, synthetic construct
  REGION 1..274: note = EVC2 (Q86UK5) ECD
GRGCLGASSRPRWRPLGAQPPRDPQVAPRSGPGLRIPPGRSGAGPESSTQDLPCMIWPKVECCHFKTAVEAPLGMKLDKKMEVFIPLSTSAASSGPWAHSLFAFIPSWPKKNLFKRESPITHRLYGDISREVQGTSENGVIFQKCALVSGSSEAQTARIWLLVNNTKTTSSANLSELLLLDSIAGLTIWDSVGNRTSEGFQAFSKKFLQVGDAFAVSYAATLQAGDLGNGESLKLPAQLTFQSSSRNRTQLKVLFSITAEENVTVLPHHGLHAA

SEQ ID NO: 1231 - protein, 103 aa, synthetic construct
  REGION 1..103: note = EVI2A (P22794) ECD
NYTRLWANSTSSWDSVIQNKTGRNQNENINTNPITPEVDYKGNSTNMPETSHIVALTSKSEQELYIPSVVSNSPSTVQSIENTSKSHGEIFKKDVCAENNNNM

SEQ ID NO: 1232 - protein, 181 aa, synthetic construct
  REGION 1..181: note = EVI2B (P34910) ECD
KTETITTEKQSQPTLFTSSMSQVLANSQNTTGNPLGQPTQFSDTFSGQSISPAKVTAGQPTPAVYTSSEKPEAHTSAGQPLAYNTKQPTPIANTSSQQAVFTSARQLPSARTSTTQPPKSFVYTFTQQSSSVQIPSRKQITVHNPSTQPTSTVKNSPRSTPGFILDTTSNKQTPQKNNYNS

SEQ ID NO: 1233 - protein, 211 aa, synthetic construct
  REGION 1..211: note = F11R (Q9Y624) ECD
SVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGV

SEQ ID NO: 1234 - protein, 219 aa, synthetic construct
  REGION 1..219: note = F3 (P13726) ECD
SGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRE

SEQ ID NO: 1235 - protein, 282 aa, synthetic construct
  REGION 1..282: note = FAM171A1 (Q5VUB5) ECD
KTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGARPQPRVHFQRRALRLPENTSYSDLTAFLTAASSPSEVDSFPYLRGLDGNGTGNSTRHDLTPVTAVSVHLLSSNGTPVLVDGPIYVTVPLATQSSLRHNAYVAAWRFDQKLGTWLKSGLGLVHQEGSQLTWTYIAPQLGYWVAAMSPPIPGPVVTQDITTYHT

SEQ ID NO: 1236 - protein, 286 aa, synthetic construct
  REGION 1..286: note = FAM171A2 (A8MVW0) ECD
KSPPEPPSPQEILIKVQVYVSGELVPLARASVDVFGNRTLLAAGTTDSEGVATLPLSYRLGTWVLVTAARPGFLTNSVPWRVDKLPLYASVSLYLLPERPATLILYEDLVHILLGSPGARSQPLVQFQRRAARLPVSSTYSQLWASLTPASTQQEMRAFPAFLGTEASSSGNGSWLELMPLTAVSVHLLTGNGTEVPLSGPIHLSLPVPSETRALTVGTSIPAWRFDPKSGLWVRNGTGVIRKEGRQLYWTFVSPQLGYWVAAMASPTAGLVTITSGIQDIGTYHT

SEQ ID NO: 1237 - protein, 321 aa, synthetic construct
  REGION 1..321: note = FAM171B (Q6P995) ECD
ELSRSDLSLIQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITLNKPGFENIELTPLAAICVKIYSGGKELKVNGSIQVSLPLLRLNDISAGDRIPAWTFDMNTGAWVNHGRGMVKEHNNHLIWTYDAPHLGYWIAAPLPGTRGSGINEDSKDITAYHT

SEQ ID NO: 1238 - protein, 94 aa, synthetic construct
  REGION 1..94: note = FAM174A (Q8TBP5) ECD
LAVLLQAAEAAPGLGPPDPRPRTLPPLPPGPTPAQQPGRGLAEAAGPRGSEGGNGSNPVAGLETDDHGGKAGEGSVGGGLAVSPNPGDKPMTQR

SEQ ID NO: 1239 - protein, 64 aa, synthetic construct
  REGION 1..64: note = FAM174B (Q3ZCQ3) ECD
SRAESVSAPWPEPERESRPPPGPGPGNTTRFGSGAAGGSGSSSSNSSGDALVTRISILLRDLPT

SEQ ID NO: 1240 - protein, 318 aa, synthetic construct
  REGION 1..318: note = FAM187B (Q17R55) ECD
FYFSISCPSGKQCQQALLSGNDILLYCNSSGAHWYYLFTQGKKGRLTSLTNISNMEIMPEGSLLIKDPLPSQTGLYHCWNKNGRQVVQYEIDFQDVTTLHITHKDLGQRPLQNETLHLGSKQLIFTWWEPWQDCNRCEEPGECKRLGYRYIEEPLEEAMPCWLYLGEVLVWSSRLRPELQVEACHVQCTNNTQLRVDYVIFDNFRLDEKTEFVWLDCPLGSMYRPVNWRANDTPLTWESQLSGQDFTTFLDPSTGGRQLQVFQPAVYKCFVQQELVAQFKPAASLETLEAQWRENDAQWREARKALRGRADSVLKGLK

SEQ ID NO: 1241 - protein, 148 aa, synthetic construct
  REGION 1..148: note = FAS (P25445) ECD
QVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSN

SEQ ID NO: 1242 - protein, 4160 aa, synthetic construct
  REGION 1..4160: note = FAT1 (Q14517) ECD
DGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVHQHTLTVMVRDQDVPVKRNFARIVVNVSDTNDHAPWFTASSYKGRVYESAAVGSVVLQVTALDKDKGKNAEVLYSIESGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAE

SEQ ID NO: 1243 - protein, 4030 aa, synthetic construct
  REGION 1..4030: note = FAT2 (Q9NYQ8) ECD
EKPLEGILSSSAWHFTHSHYNATIYENSSPKTYVESFEKMGIYLAEPQWAVRYRIISGDVANVFKTEEYVVGNFCFLRIRTKSSNTALLNREVRDSYTLIIQATEKTLELEALTRVVVHILDQNDLKPLFSPPSYRVTISEDMPLKSPICKVTATDADLGQNAEFYYAFNTRSEMFAIHPTSGVVTVAGKLNVTWRGKHELQVLAVDRMRKISEGNGFGSLAALVVHVEPALRKPPAIASVVVTPPDSNDGTTYATVLVDANSSGAEVESVEVVGGDPGKHFKAIKSYARSNEFSLVSVKDINWMEYLHGFNLSLQARSGSGPYFYSQIRGFHLPPSKLSSLKFEKAVYRVQLSEFSPPGSRVVMVRVTPAFPNLQYVLKPSSENVGFKLNARTGLITTTKLMDFHDRAHYQLHIRTSPGQASTVVVIDIVDCNNHAPLFNRSSYDGTLDENIPPGTSVLAVTATDRDHGENGYVTYSIAGPKALPFSIDPYLGIISTSKPMDYELMKRIYTFRVRASDWGSPFRREKEVSIFLQLRNLNDNQPMFEEVNCTGSIRQDWPVGKSIMTMSAIDVDELQNLKYEIVSGNELEYFDLNHFSGVISLKRPFINLTAGQPTSYSLKITASDGKNYASPTTLNITVVKDPHFEVPVTCDKTGVLTQFTKTILHFIGLQNQESSDEEFTSLSTYQINHYTPQFEDHFPQSIDVLESVPINTPLARLAATDPDAGFNGKLVYVIADGNEEGCFDIELETGLLTVAAPLDYEATNFYILNVTVYDLGTPQKSSWKLLTVNVKDWNDNAPRFPPGGYQLTISEDTEVGTTIAELTTKDADSEDNGRVRYTLLSPTEKFSLHPLTGELVVTGHLDRESEPRYILKVEARDQPSKGHQLFSVTDLIITLEDVNDNSPQCITEHNRLKVPEDLPPGTVLTFLDASDPDLGPAGEVRYVLMDGAHGTFRVDLMTGALILERELDFERRAGYNLSLWASDGGRPLARRTLCHVEVIVLDVNENLHPPHFASFVHQGQVQENSPSGTQVIVVAAQDDDSGLDGELQYFLRAGTGLAAFSINQDTGMIQTLAPLDREFASYYWLTVLAVDRGSVPLSSVTEVYIEVTDANDNPPQMSQAVFYPSIQEDAPVGTSVLQLDAWDPDSSSKGKLTFNITSGNYMGFFMIHPVTGLLSTAQQLDRENKDEHILEVTVLDNGEPSLKSTSRVVVGILDVNDNPPIFSHKLFNVRLPERLSPVSPGPVYRLVASDLDEGLNGRVTYSIEDSDEEAFSIDLVTGVVSSSSTFTAGEYNILTIKATDSGQPPLSASVRLHIEWIPWPRPSSIPLAFDETYYSFTVMETDPVNHMVGVISVEGRPGLFWFNISGGDKDMDFDIEKTTGSIVIARPLDTRRRSNYNLTVEVTDGSRTIATQVHIFMIANINHHRPQFLETRYEVRVPQDTVPGVELLRVQAIDQDKGKSLIYTIHGSQDPGSASLFQLDPSSGVLVTVGKLDLGSGPSQHTLTVMVRDQEIPIKRNFVWVTIHVEDGNLHPPRFTQLHYEASVPDTIAPGTELLQVRAMDADRGVNAEVHYSLLKGNSEGFFNINALLGIITLAQKLDQANHAPHTLTVKAEDQGSPQWHDLATVIIHVYPSDRSAPIFSKSEYFVEIPESIPVGSPILLVSAMSPSEVTYELREGNKDGVFSMNSYSGLISTQKKLDHEKISSYQLKIRGSNMAGAFTDVMVVVDIIDENDNAPMFLKSTFVGQISEAAPLYSMIMDKNNNPFVIHASDSDKEANSLLVYKILEPEALKFFKIDPSMGTLTIVSEMDYESMPSFQFCVYVHDQGSPVLFAPRPAQVIIHVRDVNDSPPRFSEQIYEVAIVGPIHPGMELLMVRASDEDSEVNYSIKTGNADEAVTIHPVTGSISVLNPAFLGLSRKLTIRASDGLYQDTALVKISLTQVLDKSLQFDQDVYWAAVKENLQDRKALVILGAQGNHLNDTLSYFLLNGTDMFHMVQSAGVLQTRGVAFDREQQDTHELAVEVRDNRTPQRVAQGLVRVSIEDVNDNPPKFKHLPYYTIIQDGTEPGDVLFQVSATDEDLGTNGAVTYEFAEDYTYFRIDPYLGDISLKKPFDYQALNKYHLKVIARDGGTPSLQSEEEVLVTVRNKSNPLFQSPYYKVRVPENITLYTPILHTQARSPEGLRLIYNIVEEEPLMLFTTDFKTGVLTVTGPLDYESKTKHVFTVRATDTALGSFSEATVEVLVEDVNDNPPTFSQLVYTTSISEGLPAQTPVIQLLASDQDSGRNRDVSYQIVEDGSDVSKFFQINGSTGEMSTVQELDYEAQQHFHVKVRAMDKGDPPLTGETLVVVNVSDINDNPPEFRQPQYEANVSELATCGHLVLKVQAIDPDSRDTSRLEYLILSGNQDRHFFINSSSGIISMFNLCKKHLDSSYNLRVGASDGVFRATVPVYINTTNANKYSPEFQQHLYEAELAENAMVGTKVIDLLAIDKDSGPYGTIDYTIINKLASEKFSINPNGQIATLQKLDRENSTERVIAIKVMARDGGGRVAFCTVKIILTDENDNPPQFKASEYTVSIQSNVSKDSPVIQVLAYDADEGQNADVTYSVNPEDLVKDVIEINPVTGVVKVKDSLVGLENQTLDFFIKAQDGGPPHWNSLVPVRLQVVPKKVSLPKFSEPLYTFSAPEDLPEGSEIGIVKAVAAQDPVIYSLVRGTTPESNKDGVFSLDPDTGVIKVRKPMDHESTKLYQIDVMAHCLQNTDVVSLVSVNIQVGDVNDNRPVFEADPYKAVLTENMPVGTSVIQVTAIDKDTGRDGQVSYRLSADPGSNVHELFAIDSESGWITTLQELDCETCQTYHFHVVAYDHGQTIQLSSQALVQVSITDENDNAPRFASEEYRGSVVENSEPGELVATLKTLDADISEQNRQVTCYITEGDPLGQFGISQVGDEWRISSRKTLDREHTAKYLLRVTASDGKFQASVTVEIFVLDVNDNSPQCSQLLYTGKVHEDVFPGHFILKVSATDLDTDTNAQITYSLHGPGAHEFKLDPHTGELTTLTALDRERKDVFNLVAKATDGGGRSCQADITLHVEDVNDNAPRFFPSHCAVAVFDNTTVKTPVAVVFARDPDQGANAQVVYSLPDSAEGHFSIDATTGVIRLEKPLQVRPQAPLELTVRASDLGTPIPLSTLGTVTVSVVGLEDYLPVFLNTEHSVQVPEDAPPGTEVLQLATLTRPGAEKTGYRVVSGNEQGRFRLDARTGILYVNASLDFETSPKYFLSIECSRKSSSSLSDVTTVMVNITDVNEHRPQFPQDPYSTRVLENALVGDVILTVSATDEDGPLNSDITYSLIGGNQLGHFTIHPKKGELQVAKALDREQASSYSLKLRATDSGQPPLHEDTDIAIQVADVNDNPPRFFQLNYSTTVQENSPIGSKVLQLILSDPDSPENGPPYSFRITKGNNGSAFRVTPDGWLVTAEGLSRRAQEWYQLQIQASDSGIPPLSSLTSVRVHVTEQSHYAPSALPLEIFITVGEDEFQGGMVGKIHATDRDPQDTLTYSLAEEETLGRHFSVGAPDGKIIAAQGLPRGHYSFNVTVSDGTFTTTAGVHVYVWHVGQEALQQAMWMGFYQLTPEELVSDHWRNLQRFLSHKLDIKRANIHLASLQPAEAVAGVDVLLVFEGHSGTFYEFQELASIITHSAKEMEHSVGVQMRSAMPMVPCQGPTCQGQICHNTVHLDPKVGPTYSTARLSILTPRHHLQRSCSCNGTATRFSGQSYVRYRAPAARNWHIHFYLKTLQPQAILLFTNETASVSLKLASGVPQLEYHCLGGFYGNLSSQRHVNDHEWHSILVEEMDASIRLMVDSMGNTSLVVPENCRGLRPERHLLLGGLILLHSSSNVSQGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQE

SEQ ID NO: 1244 - protein, 4122 aa, synthetic construct
  REGION 1..4122: note = FAT3 (Q8TDW7) ECD
LPGTGPLGFHFTHSIYNATVYENSAARTYVNSQSRMGITLIDLSWDIKYRIVSGDEEGFFKAEEVIIADFCFLRIRTKGGNSAILNREIQDNYLLIVKGSVRGEDLEAWTKVNIQVLDMNDLRPLFSPTTYSVTIAESTPLRTSVAQVTATDADIGSNGEFYYYFKNKVDLFSVHPTSGVISLSGRLNYDEKNRYDLEILAVDRGMKLYGNNGVSSTAKLYVHIERINEHAPTIHVVTHVPFSLEKEPTYAVVTVDDLDDGANGEIESVSIVAGDPLDQFFLAKEGKWLNEYKIKERKQIDWESFPYGYNLTLQAKDKGSPQKCSALKAVYIGNPTRDTVPIRFEKEVYDVSISEFSPPGVVVAIVKLSPEPIDVEYKLSPGEDAVYFKINPRSGLIVTARPLNTVKKEVYKLEVTNKEGDLKAQVTISIEDANDHTPEFQQPLYDAYVNESVPVGTSVLTVSASDKDKGENGYITYSIASLNLLPFVINQFTGVISTTEELDFESSPEIYRFIVRASDWGSPYRHESEVNVTIRIGNVNDNSPLFEKVACQGVISYDFPVGGHITAVSAIDIDELELVKYKIISGNELGFFYLNPDSGVLQLKKSLTNSGIKNGNFALRITATDGENLADPMSINISVLHGKVSSKSFSCRETRVAQKLAEKLLIKAKANGKLNLEDGFLDFYSINRQGPYFDKSFPSDVAVKEDLPVGANILKIKAYDADSGFNGKVLFTISDGNTDSCFNIDMETGQLKVLMPMDREHTDLYLLNITIYDLGNPQKSSWRLLTINVEDANDNSPVFIQDSYSVNILESSGIGTEIIQVEARDKDLGSNGEVTYSVLTDTQQFAINSSTGIVYVADQLDRESKANYSLKIEARDKAESGQQLFSVVTLKVFLDDVNDCSPAFIPSSYSVKVLEDLPVGTVIAWLETHDPDLGLGGQVRYSLVNDYNGRFEIDKASGAIRLSKELDYEKQQFYNLTVRAKDKGRPVSLSSVSFVEVEVVDVNENLHTPYFPDFAVVGSVKENSRIGTSVLQVTARDEDSGRDGEIQYSIRDGSGLGRFSIDDESGVITAADILDRETMGSYWLTVYATDRGVVPLYSTIEVYIEVEDVNDNAPLTSEPIYYPVVMENSPKDVSVIQIQAEDPDSSSNEKLTYRITSGNPQNFFAINIKTGLITTTSRKLDREQQAEHFLEVTVTDGGPSPKQSTIWVVVQVLDENDNKPQFPEKVYQIKLPERDRKKRGEPIYRAFAFDRDEGPNAEISYSIVDGNDDGKFFIDPKTGMVSSRKQFTAGSYDILTIKAVDNGRPQKSSTARLHIEWIKKPPPSPIPLTFDEPFYNFTVMESDRVTEIVGVVSVQPANTPLWFDIVGGNFDSAFDAEKGVGTIVIAKPLDAEQRSIYNMSVEVTDGTNVAVTQVFIKVLDNNDNGPEFSQPNYDVTISEDVLPDTEILQIEATDRDEKHKLSYTVHSSIDSISMRKFRIDPSTGVLYTAERLDHEAQDKHILNIMVRDQEFPYRRNLARVIVNVEDANDHSPYFTNPLYEASVFESAALGSAVLQVTALDKDKGENAELIYTIEAGNTGNMFKIEPVLGIITICKEPDMTTMGQFVLSIKVTDQGSPPMSATAIVRISVTMSDNSHPKFIHKDYQAEVNENVDIGTSVILISAISQSTLIYEVKDGDINGIFTINPYSGVITTQKALDYERTSSYQLIIQATNMAGMASNATVNIQIVDENDNAPVFLFSQYSGSLSEAAPINSIVRSLDNSPLVIRATDADSNRNALLVYQIVESTAKKFFTVDSSTGAIRTIANLDHETIAHFHFHVHVRDSGSPQLTAESPVEVNIEVTDVNDNPPVFTQAVFETILLLPTYVGVEVLKVSATDPDSEVPPELTYSLMEGSLDHFLIDSNSGVLTIKNNNLSKDHYMLIVKVSDGKFYSTSMVTIMVKEAMDSGLHFTQSFYSTSISENNTNITKVAIVNAVGNRLNEPLKYSILNPGNKFKIKSTSGVIQTTGVPFDREEQELYELVVEASRELDHLRVARVVVRVNIEDINDNSPVFVGLPYYAAVQVDAEPGTLIYQVTAIDKDKGPNGEVTYVLQDDYGHFEINPNSGNVILKEAFNSDLSNIEYGVTILAKDGGKPSLSTSVELPITIVNKAMPVFDKPFYTASVNEDIRMNTPILSINATSPEGQGIIYIIIDGDPFKQFNIDFDTGVLKVVSPLDYEVTSAYKLTIRASDALTGARAEVTVDLLVNDVNDNPPIFDQPTYNTTLSEASLIGTPVLQVVSIDADSENNKMVHYQIVQDTYNSTDYFHIDSSSGLILTARMLDHELVQHCTLKVRSIDSGFPSLSSEVLVHIYISDVNDNPPVFNQLIYESYVSELAPRGHFVTCVQASDADSSDFDRLEYSILSGNDRTSFLMDSKSGVITLSNHRKQRMEPLYSLNVSVSDGLFTSTAQVHIRVLGANLYSPAFSQSTYVAEVRENVAAGTKVIHVRATDGDPGTYGQISYAIINDFAKDRFLIDSNGQVITTERLDRENPLEGDVSIFVRALDGGGRTTFCTVRVIVVDENDNAPQFMTVEYRASVRADVGRGHLVTQVQAIDPDDGANSRITYSLYSEASVSVADLLEIDPDNGWMVTKGNFNQLKNTVLSFFVKAVDGGIPVKHSLIPVYIHVLPPETFLPSFTQSQYSFTIAEDTAIGSTVDTLRILPSQNVWFSTVNGERPENNKGGIFVIEQETGTIKLDKRLDRETSPAFHFKVAATIPLDKVDIVFTVDVDIKVLDLNDNKPVFETSSYDTIIMEGMPVGTKLTQVRAIDMDWGANGQVTYSLHSDSQPEKVMEAFNIDSNTGWISTLKDLDHETDPTFTFSVVASDLGEAFSLSSTALVSVRVTDINDNAPVFAQEVYRGNVKESDPPGEVVAVLSTWDRDTSDVNRQVSYHITGGNPRGRFALGLVQSEWKVYVKRPLDREEQDIYFLNITATDGLFVTQAMVEVSVSDVNDNSPVCDQVAYTALLPEDIPSNKIILKVSAKDADIGSNGYIRYSLYGSGNSEFFLDPESGELKTLALLDRERIPVYSLMAKATDGGGRFCQSNIHLILEDVNDNPPVFSSDHYNTCVYENTATKALLTRVQAVDPDIGINRKVVYSLADSAGGVFSIDSSSGIIILEQPLDREQQSSYNISVRATDQSPGQSLSSLTTVTITVLDINDNPPVFERRDYLVTVPEDTSPGTQVLAVFATSKDIGTNAEITYLIRSGNEQGKFKINPKTGGISVSEVLDYELCKRFYLVVEAKDGGTPALSAVATVNINLTDVNDNPPKFSQDVYSAVISEDALVGDSVILLIAEDVDSQPNGQIHFSIVNGDRDNEFTVDPVLGLVKVKKKLDRERVSGYSLLVQAVDSGIPAMSSTATVNIDISDVNDNSPVFTPANYTAVIQENKPVGTSILQLVVTDRDSFHNGPPFSFSILSGNEEEEFVLDPHGILRSAVVFQHTESLEYVLCVQAKDSGKPQQVSHTYIRVRVIEESTHKPTAIPLEIFIVTMEDDFPGGVIGKIHATDQDMYDVLTFALKSEQKSLFKVNSHDGKIIALGGLDSGKYVLNVSVSDGRFQVPIDVVVHVEQLVHEMLQNTVTIRFENVSPEDFVGLHMHGFRRTLRNAVLTQKQDSLRIISIQPVAGTNQLDMLFAVEMHSSEFYKPAYLIQKLSNARRHLENIMRISAILEKNCSGLDCQEQHCEQGLSLDSHALMTYSTARISFVCPRFYRNVRCTCNGGLCPGSNDPCVEKPCPGDMQCVSYEASRRPFLCQCPPGKLGECSGHTSLSFAGNSYIKYRLSENSKEEDFKLALRLRTLQSNGIIMYTRANPCIILKIVDGKLWFQLDCGSGPGILGISGRAVNDGSWHSVFLELNRNFTSLSLDDSYVERRRAPLYFQTLSTESSIYFGALVQADNIRSLTDTRVTQVLSGFQGCLDSVILNNNELPLQNKRSSFAEVVGLTELKLGCVLYPDACKRSPCQHGGSCTGLPSGGYQCTCLSQFTGRNCESEITACFPNPCRNGGSCDPIGNTFICNCKAGLTGVTCEEDINECEREECENGGSCVNVFGSFLCNCTPGYVGQYCGLRPVVVPNIQAGHSYVGKEE

SEQ ID NO: 1245 - protein, 4466 aa, synthetic construct
  REGION 1..4466: note = FAT4 (Q6V0I7) ECD
WVHGAEPRQVFQVLEEQPPGTLVGTIQTRPGFTYRLSESHALFAINSSTGALYTTSTIDRESLPSDVINLVVLSSAPTYPTEVRVLVRDLNDNAPVFPDPSIVVTFKEDSSSGRQVILDTATDSDIGSNGVDHRSYRIIRGNEAGRFRLDITLNPSGEGAFLHLVSKGGLDREVTPQYQLLVEVEDKGEPKRRGYLQVNVTVQDINDNPPVFGSSHYQAGVPEDAVVGSSVLQVAAADADEGTNADIRYRLQDEGTPFQMDPETGLITVREPLDFEARRQYSLTVQAMDRGVPSLTGRAEALIQLLDVNDNDPVVKFRYFPATSRYASVDENAQVGTVVALLTVTDADSPAANGNISVQILGGNEQRHFEVQSSKVPNLSLIKVASALDRERIPSYNLTVSVSDNYGAPPGAAVQARSSVASLVIFVNDINDHPPVFSQQVYRVNLSEEAPPGSYVSGISATDGDSGLNANLRYSIVSGNGLGWFHISEHSGLVTTGSSGGLDRELASQIVLNISARDQGVHPKVSYAQLVVTLLDVNDEKPVFSQPEGYDVSVVENAPTGTELLMLRATDGDLGDNGTVRFSLQEAETDRRSFRLDPVSGRLSTISSLDREEQAFYSLLVLATDLGSPPQSSMARINVSLLDINDNSPVFYPVQYFAHIKENEPGGSYITTVSATDPDLGTNGTVKYSISAGDRSRFQVNAQSGVISTRMALDREEKTAYQLQIVATDGGNLQSPNQAIVTITVLDTQDNPPVFSQVAYSFVVFENVALGYHVGSVSASTMDLNSNISYLITTGDQKGMFAINQVTGQLTTANVIDREEQSFYQLKVVASGGTVTGDTMVNITVKDLNDNSPHFLQAIESVNVVENWQAGHSIFQAKAVDPDEGVNGMVLYSLKQNPKNLFAINEKNGTISLLGPLDVHAGSYQIEILASDMGVPQLSSSVILTVYVHDVNDNSPVFDQLSYEVTLSESEPVNSRFFKVQASDKDSGANGEIAYTIAEGNTGDAFGIFPDGQLYIKSELDRELQDRYVLMVVASDRAVEPLSATVNVTVILEDVNDNRPLFNSTNYTFYFEEEQRAGSFVGKVSAVDKDFGPNGEVRYSFEMVQPDFELHAISGEITNTHQFDRESLMRRRGTAVFSFTVIATDQGIPQPLKDQATVHVYMKDINDNAPKFLKDFYQATISESAANLTQVLRVSASDVDEGNNGLIHYSIIKGNEERQFAIDSTSGQVTLIGKLDYEATPAYSLVIQAVDSGTIPLNSTCTLNIDILDENDNTPSFPKSTLFVDVLENMRIGELVSSVTATDSDSGDNADLYYSITGTNNHGTFSISPNTGSIFLAKKLDFETQSLYKLNITAKDQGRPPRSSTMSVVIHVRDFNDNPPSFPPGDIFKSIVENIPIGTSVISVTAHDPDADINGQLSYTIIQQMPRGNHFTIDEVKGTIYTNAEIDREFANLFELTVKANDQAVPIETRRYALKNVTILVTDLNDNVPMFISQNALAADPSAVIGSVLTTIMAADPDEGANGEIEYEIINGDTDTFIVDRYSGDLRVASALVPSQLIYNLIVSATDLGPERRKSTTELTIILQGLDGPVFTQPKYITILKEGEPIGTNVISIEAASPRGSEAPVEYYIVSVRCEEKTVGRLFTIGRHTGIIQTAAILDREQGACLYLVDVYAIEKSTAFPRTQRAEVEITLQDINDNPPVFPTDMLDLTVEENIGDGSKIMQLTAMDADEGANALVTYTIISGADDSFRIDPESGDLIATRRLDRERRSKYSLLVRADDGLQSSDMRINITVSDVNDHTPKFSRPVYSFDIPEDTIPGSLVAAILATDDDSGVNGEITYIVNEDDEDGIFFLNPITGVFNLTRLLDYEVQQYYILTVRAEDGGGQFTTIRVYFNILDVNDNPPIFSLNSYSTSLMENLPVGSTVLVFNVTDADDGINSQLTYSIASGDSLGQFTVDKNGVLKVLKALDRESQSFYNLVVQVHDLPQIPASRFTSTAQVSIILLDVNDNPPTFLSPKLTYIPENTPIDTVVFKAQATDPDSGPNSYIEYTLLNPLGNKFSIGTIDGEVRLTGELDREEVSNYTLTVVATDKGQPSLSSSTEVVVMVLDINDNNPIFAQALYKVEINENTLTGTDIIQVFAADGDEGTNGQVRYGIVNGNTNQEFRIDSVTGAITVAKPLDREKTPTYHLTVQATDRGSTPRTDTSTVSIVLLDINDFVPVFELSPYSVNVPENLGTLPRTILQVVARDDDRGSNSKLSYVLFGGNEDNAFTLSASGELGVTQSLDRETKERFVLMITATDSGSPALTGTGTINVIVDDVNDNVPTFASKAYFTTIPEDAPTGTDVLLVNASDADASKNAVIRIIGGNSQFTINPSTGQIITSALLDRETKDNYTLVVVCSDAGSPEPLSSSTSVLVTVTDVNDNPPRFQHHPYVTHIPSPTLPGSFVFAVTVTDADIGPNSELHYSLSGRNSEKFHIDPLRGAIMAAGPLNGASEVTFSVHVKDGGSFPKTDSTTVTVRFVNKADFPKVRAKEQTFMFPENQPVSSLVTTITGSSLRGEPMSYYIASGNLGNTFQIDQLTGQVSISQPLDFEKIQKYVVWIEARDGGFPPFSSYEKLDITVLDVNDNAPIFKEDPFISEILENLSPRKILTVSAMDKDSGPNGQLDYEIVNGNMENSFSINHATGEIRSVRPLDREKVSHYVLTIKSSDKGSPSQSTSVKVMINILDENDNAPRFSQIFSAHVPENSPLGYTVTRVTTSDEDIGINAISRYSIMDASLPFTINPSTGDIVISRPLNREDTDRYRIRVSAHDSGWTVSTDVTIFVTDINDNAPRFSRTSYYLDCPELTEIGSKVTQVFATDPDEGSNGQVFYFIKSQSEYFRINATTGEIFNKQILKYQNVTGFSNVNINRHSFIVTSSDRGKPSLISETTVTINIVDSNDNAPQFLKSKYFTPVTKNVKVGTKLIRVTAIDDKDFGLNSEVEYFISNDNHLGKFKLDNDTGWISVASSLISDLNQNFFITVTAKDKGNPPLSSQATVHITVTEENYHTPEFSQSHMSATIPESHSIGSIVRTVSARDRDAAMNGLIKYSISSGNEEGIFAINSSTGILTLAKALDYELCQKHEMTISAIDGGWVARTGYCSVTVNVIDVNDNSPVFLSDDYFPTVLENAPSGTTVIHLNATDADSGTNAVIAYTVQSSDSDLFVIDPNTGVITTQGFLDFETKQSYHLTVKAFNVPDEERCSFATVNIQLKGTNEYVPRFVSKLYYFEISEAAPKGTIVGEVFASDRDLGTDGEVHYLIFGNSRKKGFQINKKTGQIYVSGILDREKEERVSLKVLAKNFGSIRGADIDEVTVNVTVLDANDPPIFTLNIYSVQISEGVPIGTHVTFVSAFDSDSIPSWSRFSYFIGSGNENGAFSINPQTGQITVTAELDRETLPIYNLSVLAVDSGTPSATGSASLLVTLEDINDNGPMLTVSEGEVMENKRPGTLVMTLQSTDPDLPPNQGPFTYYLLSTGPATSYFSLSTAGVLSTTREIDREQIADFYLSVVTKDSGVPQMSSTGTVHITVIDQNDNPSQSRTVEIFVNYYGNLFPGGILGSVKPQDPDVLDSFHCSLTSGVTSLFSIPGGTCDLNSQPRSTDGTFDLTVLSNDGVHSTVTSNIRVFFAGFSNATVDNSILLRLGVPTVKDFLTNHYLHFLRIASSQLTGLGTAVQLYSAYEENNRTFLLAAVKRNHNQYVNPSGVATFFESIKEILLRQSGVKVESVDHDSCVHGPCQNGGSCLRRLAVSSVLKSRESLPVIIVANEPLQPFLCKCLPGYAGSWCEIDIDECLPSPCHSGGTCHNLVGGFSCSCPDGFTGRACERDINECLQSPCKNGAICQNFPGSFNCVCKTGYTGKMCESSVNYCECNPCFNGGSCQSGVDSYYCHCPFGVFGKHCELNSYGFEELSYMEFPSLDPNNNYIYVKFATIKSHALLLYNYDNQTGDRAEFLALEIAEERLRFSYNLGSGTYKLTTMKKVSDGHFHTVIARRAGMAASLTVDSCSENQEPGYCTVSNVAVSDDWTLDVQPNRVTVGGIRSLEPILQRRGHVESHDFVGCIMEFAVNGRPLEPSQALAAQGILDQCPRLEGACTRSPCQHGGTCMDYWSWQQCHCKEGLTGKYCEKSVTPDTALSLEGKGRLDYHMSQNEKREYLLRQSLRGAMLEPFGVNSLEVKFRTRSENGVLIHIQESSNYTTVKIKNGKVYFTSDAGIAGKVERNIPEVYVADGHWHTFLIGKNGTATVLSVDRIYNRDIIHPTQDFGGLDVLTISLGGIPPNQAHRDAQTAGFDGCIASMWYGGESLPFSGKHSLASISKTDPSVKIGCRGPNICASNPCWGDLLCINQWYAYRCVPPGDCASHPCQNGGSCEPGLHSGFTCSCPDSHTGRTCEMVVACLGVLCPQGKVCKAGSPAGHVCVLSQGPEEISLPLWA

SEQ ID NO: 1246 - protein, 434 aa, synthetic construct
  REGION 1..434: note = FCAMR (Q8WWV6) ECD
LPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAGPASTLPTATPAAGELTMRSYGTASPVANRWTPGTTQTLGQGTAWDTVASTPGTSKTTASAEGRRTPGATRPAAPGTGSWAEGSVKAPAPIPESPPSKSRSMSNTTEGVWEGTRSSVTNRARASKDRREMTTTKADRPREDIEGVRIALDAAKKVLGTIGPPALVSETLAWEILPQATPVSKQQSQGSIGETTPAAGMWTLGTPAADVWILGTPAADVWTSMEAASGEGSAAGDLDAATGDRGPQATLSQTPAVGPWGPPGKESSVKRTFPEDESSSR

SEQ ID NO: 1247 - protein, 206 aa, synthetic construct
  REGION 1..206: note = FCAR (P24071) ECD
QEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQN

SEQ ID NO: 1248 - protein, 180 aa, synthetic construct
  REGION 1..180: note = FCER1A (P12319) ECD
VPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQ

SEQ ID NO: 1249 - protein, 277 aa, synthetic construct [sequence omitted]

SEQ ID NO: 1250 - protein, 183 aa, synthetic construct
  REGION 1..183: note = FCGR1B (Q92637) ECD
QVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFH

SEQ ID NO: 1251 - protein, 184 aa, synthetic construct
  REGION 1..184: note = FCGR2A (P12318) ECD
QAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMG

SEQ ID NO: 1252 - protein, 175 aa, synthetic construct
  REGION 1..175: note = FCGR2B (P31994) ECD
TPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAP

SEQ ID NO: 1253 - protein, 181 aa, synthetic construct
  REGION 1..181: note = FCGR2C (P31995) ECD
TPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMG

SEQ ID NO: 1254 - protein, 192 aa, synthetic construct
  REGION 1..192: note = FCGR3A (P08637) ECD
GMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQ

SEQ ID NO: 1255 - protein, 274 aa, synthetic construct
  REGION 1..274: note = FCGRT (P55899) ECD
AESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSS

SEQ ID NO: 1256 - protein, 291 aa, synthetic construct
  REGION 1..291: note = FCRL1 (Q96LA6) ECD
AELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTS

SEQ ID NO: 1257 - protein, 382 aa, synthetic construct
  REGION 1..382: note = FCRL2 (Q96LA5) ECD
LTLVAPSSVFEGDSIVLKCQGEQNWKIQKMAYHKDNKELSVFKKFSDFLIQSAVLSDSGNYFCSTKGQLFLWDKTSNIVKIKVQELFQRPVLTASSFQPIEGGPVSLKCETRLSPQRLDVQLQFCFFRENQVLGSGWSSSPELQISAVWSEDTGSYWCKAETVTHRIRKQSLQSQIHVQRIPISNVSLEIRAPGGQVTEGQKLILLCSVAGGTGNVTFSWYREATGTSMGKKTQRSLSAELEIPAVKESDAGKYYCRADNGHVPIQSKVVNIPVRIPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGV

SEQ ID NO: 1258 - protein, 556 aa, synthetic construct
  REGION 1..556: note = FCRL3 (Q96P31) ECD
GVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLT

SEQ ID NO: 1259 - protein, 368 aa, synthetic construct
  REGION 1..368: note = FCRL4 (Q96PJ5) ECD
AHKPVISVHPPWTTFFKGERVTLTCNGFQFYATEKTTWYHRHYWGEKLTLTPGNTLEVRESGLYRCQARGSPRSNPVRLLFSSDSLILQAPYSVFEGDTLVLRCHRRRKEKLTAVKYTWNGNILSISNKSWDLLIPQASSNNNGNYRCIGYGDENDVFRSNFKIIKIQELFPHPELKATDSQPTEGNSVNLSCETQLPPERSDTPLHFNFFRDGEVILSDWSTYPELQLPTVWRENSGSYWCGAETVRGNIHKHSPSLQIHVQRIPVSGVLLETQPSGGQAVEGEMLVLVCSVAEGTGDTTFSWHREDMQESLGRKTQRSLRAELELPAIRQSHAGGYYCTADNSYGPVQSMVLNVTVRETPGNRDGL

SEQ ID NO: 1260 - protein, 836 aa, synthetic construct [sequence omitted]

SEQ ID NO: 1261 - protein, 288 aa, synthetic construct
  REGION 1..288: note = FCRL6 (Q6DN72) ECD
LYLQAWPNPVFEGDALTLRCQGWKNTPLSQVKFYRDGKFLHFSKENQTLSMGAATVQSRGQYSCSGQVMYIPQTFTQTSETAMVQVQELFPPPVLSAIPSPEPREGSLVTLRCQTKLHPLRSALRLLFSFHKDGHTLQDRGPHPELCIPGAKEGDSGLYWCEVAPEGGQVQKQSPQLEVRVQAPVSRPVLTLHHGPADPAVGDMVQLLCEAQRGSPPILYSFYLDEKIVGNHSAPCGGTTSLLFPVKSEQDAGNYSCEAENSVSRERSEPKKLSLKGSQVLFTPASNW

SEQ ID NO: 1262 - protein, 355 aa, synthetic construct
  REGION 1..355: note = FGFR1 (P11362) ECD
RPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLE

SEQ ID NO: 1263 - protein, 356 aa, synthetic construct
  REGION 1..356: note = FGFR2 (P21802) ECD
RPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLE

SEQ ID NO: 1264 - protein, 353 aa, synthetic construct
  REGION 1..353: note = FGFR3 (P22607) ECD
ESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAG

SEQ ID NO: 1265 - protein, 348 aa, synthetic construct
  REGION 1..348: note = FGFR4 (P22455) ECD
LEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTD

SEQ ID NO: 1266 - protein, 354 aa, synthetic construct
  REGION 1..354: note = FGFRL1 (Q8N441) ECD
ARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWP

SEQ ID NO: 1267 - protein, 504 aa, synthetic construct
  REGION 1..504: note = FLRT1 (Q9NZU1) ECD
IDSTTCPSVCRCDNGFIYCNDRGLTSIPADIPDDATTLYLQNNQINNAGIPQDLKTKVNVQVIYLYENDLDEFPINLPRSLRELHLQDNNVRTIARDSLARIPLLEKLHLDDNSVSTVSIEEDAFADSKQLKLLFLSRNHLSSIPSGLPHTLEELRLDDNRISTIPLHAFKGLNSLRRLVLDGNLLANQRIADDTFSRLQNLTELSLVRNSLAAPPLNLPSAHLQKLYLQDNAISHIPYNTLAKMRELERLDLSNNNLTTLPRGLFDDLGNLAQLLLRNNPWFCGCNLMWLRDWVKARAAVVNVRGLMCQGPEKVRGMAIKDITSEMDECFETGPQGGVANAAAKTTASNHASATTPQGSLFTLKAKRPGLRLPDSNIDYPMATGDGAKTLAIHVKALTADSIRITWKATLPASSFRLSWLRLGHSPAVGSITETLVQGDKTEYLLTALEPKSTYIICMVTMETSNAYVADETPVCAKAETADSYGPTTTLNQEQNAGPMASLP

SEQ ID NO: 1268 - protein, 506 aa, synthetic construct
  REGION 1..506: note = FLRT2 (O43155) ECD
CPSVCRCDRNFVYCNERSLTSVPLGIPEGVTVLYLHNNQINNAGFPAELHNVQSVHTVYLYGNQLDEFPMNLPKNVRVLHLQENNIQTISRAALAQLLKLEELHLDDNSISTVGVEDGAFREAISLKLLFLSKNHLSSVPVGLPVDLQELRVDENRIAVISDMAFQNLTSLERLIVDGNLLTNKGIAEGTFSHLTKLKEFSIVRNSLSHPPPDLPGTHLIRLYLQDNQINHIPLTAFSNLRKLERLDISNNQLRMLTQGVFDNLSNLKQLTARNNPWFCDCSIKWVTEWLKYIPSSLNVRGFMCQGPEQVRGMAVRELNMNLLSCPTTTPGLPLFTPAPSTASPTTQPPTLSIPNPSRSYTPPTPTTSKLPTIPDWDGRERVTPPISERIQLSIHFVNDTSIQVSWLSLFTVMAYKLTWVKMGHSLVGGIVQERIVSGEKQHLSLVNLEPRSTYRICLVPLDAFNYRAVEDTICSEATTHASYLNNGSNTASSHEQTTSHSMGSPF

SEQ ID NO: 1269 - protein, 500 aa, synthetic construct
  REGION 1..500: note = FLRT3 (Q9NZU0) ECD
KSCPSVCRCDAGFIYCNDRFLTSIPTGIPEDATTLYLQNNQINNAGIPSDLKNLLKVERIYLYHNSLDEFPTNLPKYVKELHLQENNIRTITYDSLSKIPYLEELHLDDNSVSAVSIEEGAFRDSNYLRLLFLSRNHLSTIPWGLPRTIEELRLDDNRISTISSPSLQGLTSLKRLVLDGNLLNNHGLGDKVFFNLVNLTELSLVRNSLTAAPVNLPGTNLRKLYLQDNHINRVPPNAFSYLRQLYRLDMSNNNLSNLPQGIFDDLDNITQLILRNNPWYCGCKMKWVRDWLQSLPVKVNVRGLMCQAPEKVRGMAIKDLNAELFDCKDSGIVSTIQITTAIPNTVYPAQGQWPAPVTKQPDIKNPKLTKDHQTTGSPSRKTITITVKSVTSDTIHISWKLALPMTALRLSWLKLGHSPAFGSITETIVTGERSEYLVTALEPDSPYKVCMVPMETSNLYLFDETPVCIETETAPLRMYNPTTTLNREQEKEPYKNPNLP

SEQ ID NO: 1270 - protein, 732 aa, synthetic construct
  REGION 1..732: note = FLT1 (P17948) ECD
SKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLE

SEQ ID NO: 1271 - protein, 517 aa, synthetic construct
  REGION 1..517: note = FLT3 (P36888) ECD
NQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNIS

SEQ ID NO: 1272 - protein, 158 aa, synthetic construct
  REGION 1..158: note = FLT3LG (P49771) ECD
TQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQP

SEQ ID NO: 1273 - protein, 751 aa, synthetic construct
  REGION 1..751: note = FLT4 (P35916) ECD
YSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSME

SEQ ID NO: 1274 - protein, 123 aa, synthetic construct
  REGION 1..123: note = FNDC4 (Q9H6D8) ECD
DRPPSPVNVTVTHLRANSATVSWDVPEGNIVIGYSISQQRQNGPGQRVIREVNTTTRACALWGLAEDSDYTVQVRSIGLRGESPPGPRVHFRTLKGSDRLPSNSSSPGDITVEGLDGERPLQT

SEQ ID NO: 1275 - protein, 121 aa, synthetic construct
  REGION 1..121: note = FNDC5 (Q8NAU1) ECD
DSPSAPVNVTVRHLKANSAVVSWDVLEDEVVIGFAISQQKKDVRMLRFIQEVNTTTRSCALWDLEEDTEYIVHVQAISIQGQSPASEPVLFKTPREAEKMASKNKDEVTMKEMGRNQQLRT

SEQ ID NO: 1276 - protein, 3875 aa, synthetic construct
  REGION 1..3875: note = FRAS1 (Q86XX4) ECD
ACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCADCHHLCQHCAADLHNTGSICLRCQNAHYLLLGDHCVPDCPSGYYAERGACKKCHSSCRTCQGRGPFSCSSCDTNLVLSHTGTCSTTCFPGHYLDDNHVCQPCNTHCGSCDSQASCTSCRDPNKVLLFGECQYESCAPQYYLDFSTNTCKECDWSCSACSGPLKTDCLQCMDGYVLQDGACVEQCLSSFYQDSGLCKNCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKVRFVHSKEKLRKGYLFLKISDQQFFSEPQLINIQAFSTQAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQNDRGLQLVANSMVWVPEGGMLQITNRILQAEAPGASAEEIIYKITQDYPQFGEVVLLVNMPADSPADEGQHLPDGRTATPTSTFTQQDINEGIVWYRHSGAPAQSDSFRFEVSSASNAQTRLESHMFNIAILPQTPEAPKVSLEASLHMTAREDGLTVIQPHSLSFINSEKPSGKIVYNITLPLHPNQGIIEHRDHPHSPIRYFTQEDINQGKVMYRPPPAAPHLQELMAFSFAGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIERKNDEPPRMTLQPLRVQLSSGVVISNSSLSLQDLDTPDNELIFVLTKKPDHGHVLWRQTASEPLENGRVLVQGSTFTYQDILAGLVGYVPSVPGMVVDEFQFSLTDGLHVDTGRMKIYTELPASDTPHLAINQGLQLSAGSVARITEQHLKVTDIDSDDHQVMYIMKEDPGAGRLQMMKHGNLEQISIKGPIRSFTQADISQGQPEYSHGTGEPGGSFAFKFDVVDGEGNRLIDKSFSISISEDKSPPVITTNKGLVLDENSVKKITTLQLSATDQDSGPTELIYRITRQPQLGHLEHAASPGIQISSFTQADLTSRNVQYVHSSEAEKHSDAFSFTLSDGVSEVTQTFHITLHPVDDSLPVVQNLGMRVQEGMRKTITEFELKAVDADTEAESVTFTIVQPPRHGTIERTSNGQHFHLTSTFTMKDIYQNRVSYSHDGSNSLKDRFTFTVSDGTNPFFIIEEGGKEIMTAAPQPFRVDILPVDDGTPRIVTNLGLQWLEYMDGKATNLITKKELLTMDPDTEDAQLVYEITTGPKHGFVENKLQPGRAAATFTQEDVNLGLIRYVLHKEKIREMMDSFQFLVKDSKPNVVSDNVFHIQWSLISFKYTSYNVSEKAGSVSVTVQRTGNLNQYAIVLCRTEQGTASSSSQPGQQDYVEYAGQVQFDEREDTKSCTIVINDDDVFENVESFTVELSMPAYALLGEFTQAKVIINDTEDEPTLEFDKKIYWVNESAGFLFAPIERKGDASSIVSAICYTVPKSAMGSLFYALESGSDFKSRGMSAASRVIFGPGVTMSTCDVMLIDDSEYEEEEEFEIALADASDNARIGRVATAKVLISGPNDASTVSLGNTAFTVSEDAGTVKIPVIRHGTDLSTFASVWCATRPSDPASATPGVDYVPSSRKVEFGPGVIEQYCTLTILDDTQYPVIEGLETFVVFLSSAQGAELTKPFQAVIAINDTFQDVPSMQFAKDLLLVKEKEGVLHVPITRSGDLSYESSVRCYTQSHSAQVMEDFEERQNADSSRITFLKGDKVKNCTVYIHDDSMFEPEEQFRVYLGLPLGNHWSGARIGKNNMATITISNDEDAPTIEFEEAAYQVREPAGPDAIAILNIKVIRRGDQNRTSKVRCSTRDGSAQSGVDYYPKSRVLKFSPGVDHIFFKVEILSNEDREWHESFSLVLGPDDPVEAVLGDVTTATVTILDQEAAGSLILPAPPIVVTLADYDHVEEVTKEGVKKSPSPGYPLVCVTPCDPHFPRYAVMKERCSEAGINQTSVQFSWEVAAPTDGNGARSPFETITDNTPFTSVNHMVLDSIYFSRRFHVRCVAKAVDKVGHVGTPLRSNIVTIGTDSAICHTPVVAGTSRGFQAQSFIATLKYLDVKHKEHPNRIHISVQIPHQDGMLPLISTMPLHNLHFLLSESIYRHQHVCSNLVTTYDLRGLAEAGFLDDVVYDSTALGPGYDRPFQFDPSVREPKTIQLYKHLNLKSCVWTFDAYYDMTELIDVCGGSVTADFQVRDSAQSFLTVHVPLYVSYIYVTAPRGWASLEHHTEMEFSFFYDTVLWRTGIQTDSVLSARLQIIRIYIREDGRLVIEFKTHAKFRGQFVMEHHTLPEVKSFVLTPDHLGGIEFDLQLLWSAQTFDSPHQLWRATSSYNRKDYSGEYTIYLIPCTVQPTQPWVDPGEKPLACTAHAPERFLIPIAFQQTNRPVPVVYSLNTEFQLCNNEKVFLMDPNTSDMSLAEMDYKGAFSKGQILYGRVLWNPEQNLNSAYKLQLEKVYLCTGKDGYVPFFDPTGTIYNEGPQYGCIQPNKHLKHRFLLLDRNQPEVTDKYFHDVPFEAHFASELPDFHVVSNMPGVDGFTLKVDALYKVEAGHQWYLQVIYIIGPDTISGPRVQRSLTAPLRRNRRDLVEPDGQLILDDSLIYDNEGDQVKNGTNMKSLNLEMQELAVAASLSQTGAS

SEQ ID NO: 1277 - protein, 3067 aa, synthetic construct
  REGION 1..3067: note = FREM2 (Q5SZK8) ECD
QPAAFGRALLSPGLAGAAGVPAEEAIVLANRGLRVPFGREVWLDPLHDLVLQVQPGDRCAVSVLDNDALAQRPGRLSPKRFPCDFGPGEVRYSHLGARSPSRDRVRLQLRYDAPGGAVVLPLVLEVEVVFTQLEVVTRNLPLVVEELLGTSNALDARSLEFAFQPETEECRVGILSGLGALPRYGELLHYPQVPGGAREGGAPETLLMDCKAFQELGVRYRHTAASRSPNRDWIPMVVELRSRGAPVGSPALKREHFQVLVRIRGGAENTAPKPSFVAMMMMEVDQFVLTALTPDMLAAEDAESPSDLLIFNLTSPFQPGQGYLVSTDDRSLPLSSFTQRDLRLLKIAYQPPSEDSDQERLFELELEVVDLEGAASDPFAFMVVVKPMNTMAPVVTRNTGLILYEGQSRPLTGPAGSGPQNLVISDEDDLEAVRLEVVAGLRHGHLVILGASSGSSAPKSFTVAELAAGQVVYQHDDRDGSLSDNLVLRMVDGGGRHQVQFLFPITLVPVDDQPPVLNANTGLTLAEGETVPILPLSLSATDMDSDDSLLLFVLESPFLTTGHLLLRQTHPPHEKQELLRGLWRKEGAFYERTVTEWQQQDITEGRLFYRHSGPHSPGPVTDQFTFRVQDNHDPPNQSGLQRFVIRIHPVDRLPPELGSGCPLRMVVQESQLTPLRKKWLRYTDLDTDDRELRYTVTQSPTDTDENHLPAPLGTLVLTDNPSVVVTHFTQAQINHHKIAYRPPGQELGVATRVAQFQFQVEDRAGNVAPGTFTLYLHPVDNQPPEILNTGFTIQEKGHHILSETELHVNDVDTDVAHISFTLTQAPKHGHMRVSGQILHVGGLFHLEDIKQGRVSYAHNGDKSLTDSCSLEVSDRHHVVPITLRVNVRPVDDEVPILSHPTGTLESYLDVLENGATEITANVIKGTNEETDDLMLTFLLEDPPLYGEILVNGIPAEQFTQRDILEGSVVYTHTSGEIGLLPKADSFNLSLSDMSQEWRIGGNTIQGVTIWVTILPVDSQAPEIFVGEQLIVMEGDKSVITSVHISAEDVDSLNDDILCTIVIQPTSGYVENISPAPGSEKSRAGIAISAFNLKDLRQGHINYVQSVHKGVEPVEDRFVFRCSDGINFSERQFFPIVIIPTNDEQPEMFMREFMVMEGMSLVIDTPILNAADADVPLDDLTFTITQFPTHGHIMNQLINGTVLVESFTLDQIIESSSIIYEHDDSETQEDSFVIKLTDGKHSVEKTVLIIVIPVDDETPRMTINNGLEIEIGDTKIINNKILMATDLDSEDKSLVYIIRYGPGHGLLQRRKPTGAFENITLGMNFTQDEVDRNLIQYVHLGQEGIRDLIKFDVTDGINPLIDRYFYVSIGSIDIVFPDVISKGVSLKEGGKVTLTTDLLSTSDLNSPDENLVFTITRAPMRGHLECTDQPGVSITSFTQLQLAGNKIYYIHTADDEVKMDSFEFQVTDGRNPVFRTFRISISDVDNKKPVVTIHKLVVSESENKLITPFELTVEDRDTPDKLLKFTITQVPIHGHLLFNNTRPVMVFTKQDLNENLISYKHDGTESSEDSFSFTVTDGTHTDFYVFPDTVFETRRPQVMKIQVLAVDNSVPQIAVNKGASTLRTLATGHLGFMITSKILKVEDRDSLHISLRFIVTEAPQHGYLLNLDKGNHSITQFTQADIDDMKICYVLREGANATSDMFYFAVEDGGGNKLTYQNFRLNWAWISFEKEYYLVNEDSKFLDVVLKRRGYLGETSFISIGTRDRTAEKDKDFKGKAQKQVQFNPGQTRATWRVRILSDGEHEQSETFQVVLSEPVLAALEFPTVATVEIVDPGDEPTVFIPQSKYSVEEDVGELFIPIRRSGDVSQELMVVCYTQQGTATGTVPTSVLSYSDYISRPEDHTSVVRFDKDEREKLCRIVIIDDSLYEEEETFHVLLSMPMGGRIGSEFPGAQVTIVPDKDDEPIFYFGDVEYSVDESAGYVEVQVWRTGTDLSKSSSVTVRSRKTDPPSADAGTDYVGISRNLDFAPGVNMQPVRVVILDDLGQPALEGIEKFELVLRMPMNAALGEPSKATVSINDSVSDLPKMQFKERIYTGSESDGQIVTMIHRTGDVQYRSSVRCYTRQGSAQVMMDFEERPNTDTSIITFLPGETEKPCILELMDDVLYEEVEELRLVLGTPQSNSPFGAAVGEQNETLIRIRDDADKTVIKFGETKFSVTEPKEPGESVVIRIPVIRQGDTSKVSIVRVHTKDGSATSGEDYHPVSEEIEFKEGETQHVVEIEVTFDGVREMREAFTVHLKPDENMIAEMQLTKAIVYIEEMSSMADVTFPSVPQIVSLLMYDDTSKAKESAEPMSGYPVICITACNPKYSDYDKTGSICASENINDTLTRYRWLISAPAGPDGVTSPMREVDFDTFFTSSKMVTLDSIYFQPGSRVQCAARAVNTNGDEGLELMSPIVTISREEGLCQPRVPGVVGAEPFSAKLRYTGPEDADYTNLIKLTVTMPHIDGMLPVISTRELSNFELTLSPDGTRVGNHKCSNLLDYTEVKTHYGFLTDATKNPEIIGETYPYQYSLSIRGSTTLRFYRNLNLEACLWEFVSYYDMSELLADCGGTIGTDGQVLNLVQSYVTLRVPLYVSYVFHSPVGVGGWQHFDLKSELRLTFVYDTAILWNDGIGSPPEAELQGSLYPTSMRIGDEGRLAVHFKTEAQFHGLFVLSHPASFTSSVIMSADHPGLTFSLRLIRSEPTYNQPVQQWSFVSDFAVRDYSGTYTVKLVPCTAPSHQEYRLPVTCNPREPVTFDLDIRFQQVSDPVAAEFSLNTQMYLLSKKSLWLSDGSMGFGQESDVAFAEGDIIYGRVMVDPVQNLGDSFYCSIEKVFLCTGADGYVPKYSPMNAEYGCLADSPSLLYRFKIVDKAQPETQATSFGNVLFNAKLAVDDPEAILLVNQPGSDGFKVDSTPLFQVALGREWYIHTIYTVRSKDNANRGIGKRSVEYHSLVSQGKPQSTTKSRKKREIRSTPSLAWEIGAENSRGTNIQHIALDRTKRQIPHGRAPPDGILPWELNSPSSAVSLVT

SEQ ID NO: 1278 - protein, 608 aa, synthetic construct
  REGION 1..608: note = FURIN (P09958) ECD
DVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPE

SEQ ID NO: 1279 - protein, 125 aa, synthetic construct
  REGION 1..125: note = G6B (O95866) ECD
NPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQ

SEQ ID NO: 1280 - protein, 333 aa, synthetic construct
  REGION 1..333: note = GFRAL (Q6UXV0) ECD
SQTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGE

SEQ ID NO: 1281 - protein, 390 aa, synthetic construct
  REGION 1..390: note = GFY (I3L273) ECD
KAAPSAPLPLGCGFPDMAHPSETSPLKGASENSKRDRLNPEFPGTPYPEPSKLPHTVSLETFPLDFTEPLNPDLRETPHPESPETPKADSLTTSISESLDMPKTNLSKMAHPESSETPTPGPTEMPHPGSPETPKPNFSKTSRPEFPETPNTDLMQTTPQESPEILQLNATEVSQAELPETSNTNPTKTPDPKSPEKHDLNSTETPNSEFLQALHPDPSKTPHPESHVTHNPSPTEISQTEFPTTYYQNATDVPRTSDPQISTSLYPETPVPFKDDATALNELSLNPKPGTPAAIQPDSPKLPTSDSPGMVELKAPQNSGPKESNVPPPSARIAGPPALPGRPSQLAPATLRAPQRHSRGEGVNTIIVVERVKETGVTLVGRPRGAAGGA

SEQ ID NO: 1282 - protein, 246 aa, synthetic construct
  REGION 1..246: note = GHR (P10912) ECD
FSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFY

SEQ ID NO: 1283 - protein, 245 aa, synthetic construct
  REGION 1..245: note = GINM1 (Q9NU53) ECD
WLTTGAPEPPPLSGAPQDGIRINVTTLKDDGDISKQQVVLNITYESGQVYVNDLPVNSGVTRISCQTLIVKNENLENLEEKEYFGIVSVRILVHEWPMTSGSSLQLIVIQEEVVEIDGKQVQQKDVTEIDILVKNRGVLRHSNYTLPLEESMLYSISRDSDILFTLPNLSKKESVSSLQTTSQYLIRNVETTVDEDVLPGKLPETPLRAEPPSSYKVMCQWMEKFRKDLCRFWSNVFPVFFQFLN

SEQ ID NO: 1284 - protein, 211 aa, synthetic construct
  REGION 1..211: note = GLIPR1 (P48060) ECD
ANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVNRQRDQVKRYYSVVYPGWPIYPRNR

SEQ ID NO: 1285 - protein, 515 aa, synthetic construct
  REGION 1..515: note = GP1BA (P07359) ECD
HPICEVSKVASHLEVNCDKRNLTALPPDLPKDTTILHLSENLLYTFSLATLMPYTRLTQLNLDRCELTKLQVDGTLPVLGTLDLSHNQLQSLPLLGQTLPALTVLDVSFNRLTSLPLGALRGLGELQELYLKGNELKTLPPGLLTPTPKLEKLSLANNNLTELPAGLLNGLENLDTLLLQENSLYTIPKGFFGSHLLPFAFLHGNPWLCNCEILYFRRWLQDNAENVYVWKQGVDVKAMTSNVASVQCDNSDKFPVYKYPGKGCPTLGDEGDTDLYDYYPEEDTEGDKVRATRTVVKFPTKAHTTPWGLFYSWSTASLDSQMPSSLHPTQESTKEQTTFPPRWTPNFTLHMESITFSKTPKSTTEPTPSPTTSEPVPEPAPNMTTLEPTPSPTTPEPTSEPAPSPTTPEPTSEPAPSPTTPEPTSEPAPSPTTPEPTPIPTIATSPTILVSATSLITPKSTFLTTTKPVSLLESTKKTIPELDQPPKLRGVLQGHLESSRNDPFLHPDFCCLLPL

SEQ ID NO: 1286 - protein, 122 aa, synthetic construct
  REGION 1..122: note = GP1BB (P13224) ECD
CPAPCSCAGTLVDCGRRGLTWASLPTAFPVDTTELVLTGNNLTALPPGLLDALPALRTAHLGANPWRCDCRLVPLRAWLAGRPERAPYRDLRCVAPPALRGRLLPYLAEDELRAACAPGPLC

SEQ ID NO: 1287 - protein, 507 aa, synthetic construct
  REGION 1..507: note = GP5 (P40197) ECD
QPFPCPPACKCVFRDAAQCSGGDVARISALGLPTNLTHILLFGMGRGVLQSQSFSGMTVLQRLMISDSHISAVAPGTFSDLIKLKTLRLSRNKITHLPGALLDKMVLLEQLFLDHNALRGIDQNMFQKLVNLQELALNQNQLDFLPASLFTNLENLKLLDLSGNNLTHLPKGLLGAQAKLERLLLHSNRLVSLDSGLLNSLGALTELQFHRNHIRSIAPGAFDRLPNLSSLTLSRNHLAFLPSALFLHSHNLTLLTLFENPLAELPGVLFGEMGGLQELWLNRTQLRTLPAAAFRNLSRLRYLGVTLSPRLSALPQGAFQGLGELQVLALHSNGLTALPDGLLRGLGKLRQVSLRRNRLRALPRALFRNLSSLESVQLDHNQLETLPGDVFGALPRLTEVLLGHNSWRCDCGLGPFLGWLRQHLGLVGGEEPPRCAGPGAHAGLPLWALPGGDAECPGPRGPPPRPAADSSSEAPVHPALAPNSSEPWVWAQPVTTGKGQDHSPFWG

SEQ ID NO: 1288 - protein, 247 aa, synthetic construct
  REGION 1..247: note = GP6 (Q9HCN6) ECD
QSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSPVAEFSEATAELTVSFTNEVFTTETSRSITASPKESDSPAGPARQYYTK

SEQ ID NO: 1289 - protein, 214 aa, synthetic construct
  REGION 1..214: note = GPA33 (Q99795) ECD
ISVETPQDVLRASQGKSVTLPCTYHTSTSSREGLIQWDKLLLTHTERVVIWPFSNKNYIHGELYKNRVSISNNAEQSDASITIDQLTMADNGTYECSVSLMSDLEGNTKSRVRLLVLVPPSKPECGIEGETIIGNNIQLTCQSKEGSPTPQYSWKRYNILNQEQPLAQPASGQPVSLKNISTDTSGYYICTSSNEEGTQFCNITVAVRSPSMNV

SEQ ID NO: 1290 - protein, 476 aa, synthetic construct
  REGION 1..476: note = GPNMB (Q14956) ECD
KRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMAN

SEQ ID NO: 1291 - protein, 407 aa, synthetic construct
  REGION 1..407: note = GUCY2C (P25092) ECD
SQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQ

SEQ ID NO: 1292 - protein, 72 aa, synthetic construct
  REGION 1..72: note = GYPA (P02724) ECD
SSTTGVAMHTSTSSSVTKSYISSQTNDTHKRDTYAATPRAHEVSEISVRTVYPPEEETGERVQLAHHFSEPE

SEQ ID NO: 1293 - protein, 275 aa, synthetic construct
  REGION 1..275: note = HAVCR1 (Q96D42) ECD
SVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKG

SEQ ID NO: 1294 - protein, 181 aa, synthetic construct
  REGION 1..181: note = HAVCR2 (Q8TDQ0) ECD
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 1295 - protein, 141 aa, synthetic construct
  REGION 1..141: note = HBEGF (Q99075) ECD
LVTGESLERLRRGLAAGTSNPDPPTVSTDQLLPLGGGRDRKVRDLQEADLDLLRVTLSSKPQALATPNKEEHGKRKKKGKGLGKKRDPCLRKYKDFCIHGECKYVKELRAPSCICHPGYHGERCHGLSLPVENRLYTYDHT

SEQ ID NO: 1296 - protein, 1219 aa, synthetic construct
  REGION 1..1219: note = HEG1 (Q9ULI3) ECD
TRDPPPSPARRALSLAPLAGAGLELQLERRPEREPPPTPPRERRGPATPGPSYRAPEPGAATQRGPSGRAPRGGSADAAWKHWPESNTEAHVENITFYQNQEDFSTVSSKEGVMVQTSGKSHAASDAPENLTLLAETADARGRSGSSSRTNFTILPVGYSLEIATALTSQSGNLASESLHLPSSSSEFDERIAAFQTKSGTASEMGTERAMGLSEEWTVHSQEATTSAWSPSFLPALEMGELTTPSRKRNSSGPDLSWLHFYRTAASSPLLDLSSSSESTEKLNNSTGLQSSSVSQTKTMHVATVFTDGGPRTLRSLTVSLGPVSKTEGFPKDSRIATTSSSVLLSPSAVESRRNSRVTGNPGDEEFIEPSTENEFGLTSLRWQNDSPTFGEHQLASSSEVQNGSPMSQTETVSRSVAPMRGGEITAHWLLTNSTTSADVTGSSASYPEGVNASVLTQFSDSTVQSGGSHTALGDRSYSESSSTSSSESLNSSAPRGERSIAGISYGQVRGTAIEQRTSSDHTDHTYLSSTFTKGERALLSITDNSSSSDIVESSTSYIKISNSSHSEYSSFFHAQTERSNISSYDGEYAQPSTESPVLHTSNLPSYTPTINMPNTSVVLDTDAEFVSDSSSSSSSSSSSSSSGPPLPLPSVSQSHHLFSSILPSTRASVHLLKSTSDASTPWSSSPSPLPVSLTTSTSAPLSVSQTTLPQSSSTPVLPRARETPVTSFQTSTMTSFMTMLHSSQTADLKSQSTPHQEKVITESKSPSLVSLPTESTKAVTTNSPLPPSLTESSTEQTLPATSTNLAQMSPTFTTTILKTSQPLMTTPGTLSSTASLVTGPIAVQTTAGKQLSLTHPEILVPQISTEGGISTERNRVIVDATTGLIPLTSVPTSAKEMTTKLGVTAEYSPASRSLGTSPSPQTTVVSTAEDLAPKSATFAVQSSTQSPTTVSSSASVNSCAVNPCLHNGECVADNTSRGYHCRCPPSWQGDDCSVDVNECLSNPCPSTAMCNNTQGSFICKCPVGYQLEKGICNLVRTFVTEFKLKRTFLNTTVEKHSDLQEVENEITKTLNMCFSALPSYIRSTVHASRESNAVVISLQTTFSLASNVTLFDLADRMQKCVNSCKSSAEVCQLLGSQRRIFRAGSLCKRKSPECDKDTSICTDLDGVALCQCKSGYFQFNKMDHSCRACEDGYRLENETCMSCPFGLGGLNCGNPYQL

SEQ ID NO: 1297 - protein, 207 aa, synthetic construct
  REGION 1..207: note = HEPACAM (Q14CZ8) ECD
VNITSPVRLIHGTVGKSALLSVQYSSTSSDRPVVKWQLKRDKPVTVVQSIGTEVIGTLRPDYRDRIRLFENGSLLLSDLQLADEGTYEVEISITDDTFTGEKTINLTVDVPISRPQVLVASTTVLELSEAFTLNCSHENGTKPSYTWLKDGKPLLNDSRMLLSPDQKVLTITRVLMEDDDLYSCMVENPISQGRSLPVKITVYRRSS

SEQ ID NO: 1298 - protein, 320 aa, synthetic construct
  REGION 1..320: note = HEPACAM2 (A8MVW5) ECD
LKVTVPSHTVHGVRGQALYLPVHYGFHTPASDIQIIWLFERPHTMPKYLLGSVNKSVVPDLEYQHKFTMMPPNASLLINPLQFPDEGNYIVKVNIQGNGTLSASQKIQVTVDDPVTKPVVQIHPPSGAVEYVGNMTLTCHVEGGTRLAYQWLKNGRPVHTSSTYSFSPQNNTLHIAPVTKEDIGNYSCLVRNPVSEMESDIIMPIIYYGPYGLQVNSDKGLKVGEVFTVDLGEAILFDCSADSHPPNTYSWIRRTDNTTYIIKHGPRLEVASEKVAQKTMDYVCCAYNNITGRQDETHFTVIITSVGLEKLAQKGKSLSP

SEQ ID NO: 1299 - protein, 1087 aa, synthetic construct
  REGION 1..1087: note = HEPH (Q9BQS7) ECD
ATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLAS

SEQ ID NO: 1300 - protein, 1090 aa, synthetic construct
  REGION 1..1090: note = HEPHL1 (Q6MZM0) ECD
VTRTYYIGIVEEYWNYVPQGKNVITGKSFTEDKLATLFLERGPNRIGSIYKKAVYRRFTDGTYSIEIPKPPWLGFLGPILRAEVGDVIVIHLKNFASRPYSLHPHGVFYNKDSEGALYPDGTSGRNKNDDMVPPGKNYTYVWPVREEYAPTPADANCLTWVYHSHIDAPKDICSGLIGPLLVCKEGILNRYSGTRNDVDREFVIMFTLVDENQSWYLNENIKHFCTNPDSVDKKDAVFQRSNKMHALNGYLFGNFPEPDMCVGESVSWHLFGMGNEIDIHSIYFYGNTFISRGHRTDVVNLFPATFLTTEMIAENPGKWMITCQVSDHLQAGMLGQYNVDNCKSDIFYPKMKGQQRRYFIAAEKILWDYAPQGYNKFSGLPLNASGSDSDLYFTQGDNRIGGKYWKVRYTEFVDATFTKRKRLSAEEAHLGILGPVIKAEVGDTLLVTFANKADKVYSILPHGVIYDKASDAAPNLDGFVKPGAHVKPGETFTYKWTVPESVSPTAGDPPCLTYLYFSAVDPIKDTSSGLVGPLLVCKKGVLNADGTQKGIDKEFYLLFTVFDENLSRYFDENIQKFIWHPFSIDKEDKEFVKSNRMHAVNGYMYGNQPGLNMCKRDRVSWHLIGLGTDTDMHGIVFQGNTIHLRGTHRDSLALFPHMATTAFMQPDHAGIFRVFCATMPHLSRGMGQIYEVSSCDNRDPSEQRYGMIRTFYIAAEEVEWDYAPNKNWEFEKQHVDARGERHGDIFMNRTENWIGSQYKKVVYREYTDGEFVEIKARPPREEHLELLGPMIHAEVGNTVLIIFKNKASRPYSISAQGVEEMDSGKQFQVPMTKPGEVKTYRWNIPKRSGPGPSDPNCIPWVYYSTVNFVKDTYSGLMGPLITCRKGVLNEKGRRSDVDYEFALLFLVFNENESWYLDDNIKKYLNKDPRDFKRTDDFEESNRMHAINGKIFGNLHGLIMNEDTMTNWYLLGIGSEVDIHTIHYHAESFLFKIDKSYREDVYDLFPGTFQTIELFADHPGTWLLHCHVSDHIHAGMETTYTVLRNIDNRIPYSTTSPGVASHPATVPSNERPGKEQLYFFGKNLGPTGAKA

SEQ ID NO: 1301 - protein, 480 aa, synthetic construct
  REGION 1..480: note = HERVH59 (Q9N2J8) ECD
LPLPSYLHHTINLTHSLPAASNPSLANNCWLCISLSSSAYIAVPTLQTDRATSPVSLHLRTSFNSPHLYPPEELIYFLDRSSKTSPDISHQPAAALLHIYLKNLSPYINSTPPIFGPLTTQTTIPVAAPLCISRQRPTGIPLGNISPSRCSFTLHLQSPTTHVTETIGVFQLHIIDKPSINTDKLKNVSSNYCLGRHLPYISLHPWLPSPCSSDSPPRPSSCLLTPSPQNNSERLLVDTQRFLIHHENRTSSSMQLAHQSPLQPLTAAALAGSLGVWVQDTPFSTPSHPFSLHLQFCLTQGLFFLCGSSTYMCLPANWTGTCTLVFLTPKIQFANGTKELPVPLMTLTPQKRVIPLIPLMVGLGLSASTIALSTGIAGISTSVTTFRSPSNDFSASITDISQTLSVLQAQVDSLAAVVLQNRRGLGLSILLNEECCFYLNQSGLVYENIKKLKDRAQKLANQASNYAESPWALSNWMSWV

SEQ ID NO: 1302 - protein, 488 aa, synthetic construct
  REGION 1..488: note = HERVH62 (Q9N2K0) ECD
LPLPSYLHHTINLTHSLLAASNPSLVNNCWLCISLSSSAYTAVPAVQTDWATSPISLHLRTSFNSPHLYPPEELIYFLDRSSKTSPDISHQQAAALLRTYLKNLSPYINSTPPIFGPLTTQTTIPVAAPLCISWQRPTGIPLGNLSPSRCSFTLHLRSPTTNINETIGAFQLHITDKPSINTDKLKNISSNYCLGRHLPCISLHPWLSSPCSSDSPPRPSSCLLIPSPENNSERLLVDTRRFLIHHENRTFPSTQLPHQSPLQPLTAAALAGSLGVWVQDTPFSTPSHLFTLHLQFCLAQGLFFLCGSSTYMCLPANWTGTCTLVFLTPKIQFANGTEELPVPLMTPTQQKRVIPLIPLMVGLGLSASTVALGTGIAGISTSVMTFRSLSNDFSASITDISQTLSVLQAQVDSLAAVVLQNRRGLDLLTAEKGGLCIFLNEECCFYLNQSGLVYDNIKKLKDRAQKLANQASNYAEPPWALSNWMSWV

SEQ ID NO: 1303 - protein, 543 aa, synthetic construct
  REGION 1..543: note = HERVK_113 (Q902F9) ECD
LPMPAGAAAANYTYWAYVPFPPLIRAVTWMDNPIEIYVNDSVWVPGPTDDCCPAKPEEEGMMINISIGYRYPPICLGRAPGCLMPAVQNWLVEVPTVSPISRFTYHMVSGMSLRPRVNYLQDFSYQRSLKFRPKGKPCPKEIPKESKNTEVLVWEECVANSAVILQNNEFGTLIDWAPRGQFYHNCSGQTQSCPSAQVSPAVDSDLTESLDKHKHKKLQSFYPWEWGEKGISTARPKIISPVSGPEHPELWRLTVASHHIRIWSGNQTLETRDRKPFYTIDLNSSLTVPLQSCVKPPYMLVVGNIVIKPDSQTITCENCRLLTCIDSTFNWQHRILLVRAREGVWIPVSMDRPWEASPSVHILTEVLKGVLNRSKRFIFTLIAVIMGLIAVTATAAVAGVALHSSVQSVNFVNDWQNNSTRLWNSQSSIDQKLANQINDLRQTVIWMGDRLMSLEHRFQLQCDWNTSDFCITPQIYNESEHHWDMVRCHLQGREDNLTLDISKLKEQIFEASKAHLNLVPGTEAIAGVADGLANLNTVTWVKT

SEQ ID NO: 1304 - protein, 284 aa, synthetic construct
  REGION 1..284: note = HFE (Q30201) ECD
RLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLV

SEQ ID NO: 1305 - protein, 322 aa, synthetic construct
  REGION 1..322: note = HHLA2 (Q9UM44) ECD
IFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHN

SEQ ID NO: 1306 - protein, 98 aa, synthetic construct
  REGION 1..98: note = HIDE1 (A8MVS5) ECD
IRLVPPYPSSQEDPIHIACMAPGNFPGANFTLYRGGQVVQLLQAPTDQRGVTFNLSGGSSKAPGGPFHCQYGVLGELNQSQLSDLSEPVNVSFPVPTW

SEQ ID NO: 1307 - protein, 284 aa, synthetic construct
  REGION 1..284: note = HLA-A (P01891) ECD
GSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPI

SEQ ID NO: 1308 - protein, 284 aa, synthetic construct; identical to SEQ ID NO: 1307
  REGION 1..284: note = HLA-A (P01892) ECD

SEQ ID NO: 1309 - protein, 284 aa, synthetic construct; identical to SEQ ID NO: 1307
  REGION 1..284: note = HLA-A (P04439) ECD

SEQ ID NO: 1310 - protein, 284 aa, synthetic construct; identical to SEQ ID NO: 1307
  REGION 1..284: note = HLA-A (P05534) ECD

SEQ ID NO: 1311 - protein, 284 aa, synthetic construct; identical to SEQ ID NO: 1307
  REGION 1..284: note = HLA-A (P10314) ECD

SEQ ID NO: 1312 - protein, 284 aa, synthetic construct; identical to SEQ ID NO: 1307
  REGION 1..284: note = HLA-A (P10316) ECD

SEQ ID NO: 1313 - protein, 284 aa, synthetic construct; identical to SEQ ID NO: 1307
  REGION 1..284: note = HLA-A (P13746) ECD

SEQ ID NO: 1314 - protein, 284 aa, synthetic construct; identical to SEQ ID NO: 1307
  REGION 1..284: note = HLA-A (P16188) ECD

SEQ ID NO: 1315 - protein, 284 aa, synthetic construct; identical to SEQ ID NO: 1307
  REGION 1..284: note = HLA-A (P16189) ECD

SEQ ID NO: 1316 - protein, 284 aa, synthetic construct; identical to SEQ ID NO: 1307
  REGION 1..284: note = HLA-A (P16190) ECD

SEQ ID NO: 1317 - protein, 284 aa, synthetic construct; identical to SEQ ID NO: 1307
  REGION 1..284: note = HLA-A (P18462) ECD

SEQ ID NO: 1318 - protein, 284 aa, synthetic construct; identical to SEQ ID NO: 1307
  REGION 1..284: note = HLA-A (P30443) ECD

SEQ ID NO: 1319 - protein, 284 aa, synthetic construct; identical to SEQ ID NO: 1307
  REGION 1..284: note = HLA-A (P30447) ECD

SEQ ID NO: 1320 - protein, 284 aa, synthetic construct; identical to SEQ ID NO: 1307
  REGION 1..284: note = HLA-A (P30450) ECD

SEQ ID NO: 1321 - protein, 284 aa, synthetic construct; identical to SEQ ID NO: 1307
  REGION 1..284: note = HLA-A (P30453) ECD

SEQ ID NO: 1322 - protein, 284 aa, synthetic construct; identical to SEQ ID NO: 1307
  REGION 1..284: note = HLA-A (P30455) ECD

SEQ ID NO: 1323 - protein, 284 aa, synthetic construct; identical to SEQ ID NO: 1307
  REGION 1..284: note = HLA-A (P30456) ECD

SEQ ID NO: 1324 - protein, 284 aa, synthetic construct; identical to SEQ ID NO: 1307
  REGION 1..284: note = HLA-A (P30457) ECD

SEQ ID NO: 1325 - protein, 284 aa, synthetic construct; identical to SEQ ID NO: 1307
  REGION 1..284: note = HLA-A (P30459) ECD

SEQ ID NO: 1326 - protein, 284 aa, synthetic construct; identical to SEQ ID NO: 1307
  REGION 1..284: note = HLA-A (P30512) ECD

SEQ ID NO: 1327 - protein, 284 aa, synthetic construct; identical to SEQ ID NO: 1307
  REGION 1..284: note = HLA-A (Q09160) ECD

SEQ ID NO: 1328 - protein, 285 aa, synthetic construct
  REGION 1..285: note = HLA-B (P01889) ECD
GSHSMRYFYTSVSRPGRGEPRFISVGYVDDTQFVRFDSDAASPREEPRAPWIEQEGPEYWDRNTQIYKAQAQTDRESLRNLRGYYNQSEAGSHTLQSMYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIV

SEQ ID NO: 1329 - protein, 285 aa, synthetic construct; identical to SEQ ID NO: 1328
  REGION 1..285: note = HLA-B (P03989) ECD

SEQ ID NO: 1330 - protein, 285 aa, synthetic construct; identical to SEQ ID NO: 1328
  REGION 1..285: note = HLA-B (P10319) ECD

SEQ ID NO: 1331 - protein, 285 aa, synthetic construct; identical to SEQ ID NO: 1328
  REGION 1..285: note = HLA-B (P18463) ECD

SEQ ID NO: 1332 - protein, 285 aa, synthetic construct; identical to SEQ ID NO: 1328
  REGION 1..285: note = HLA-B (P18464) ECD

SEQ ID NO: 1333 - protein, 285 aa, synthetic construct; identical to SEQ ID NO: 1328
  REGION 1..285: note = HLA-B (P18465) ECD

SEQ ID NO: 1334 - protein, 285 aa, synthetic construct; identical to SEQ ID NO: 1328
  REGION 1..285: note = HLA-B (P30460) ECD

SEQ ID NO: 1335 - protein, 285 aa, synthetic construct; identical to SEQ ID NO: 1328
  REGION 1..285: note = HLA-B (P30461) ECD

SEQ ID NO: 1336 - protein, 285 aa, synthetic construct; identical to SEQ ID NO: 1328
  REGION 1..285: note = HLA-B (P30462) ECD

SEQ ID NO: 1337 - protein, 285 aa, synthetic construct; identical to SEQ ID NO: 1328
  REGION 1..285: note = HLA-B (P30464) ECD

SEQ ID NO: 1338 - protein, 285 aa, synthetic construct; identical to SEQ ID NO: 1328
  REGION 1..285: note = HLA-B (P30466) ECD

SEQ ID NO: 1339 - protein, 285 aa, synthetic construct; identical to SEQ ID NO: 1328
  REGION 1..285: note = HLA-B (P30475) ECD

SEQ ID NO: 1340 - protein, 285 aa, synthetic construct; identical to SEQ ID NO: 1328
  REGION 1..285: note = HLA-B (P30479) ECD

SEQ ID NO: 1341 - protein, 285 aa, synthetic construct; identical to SEQ ID NO: 1328
  REGION 1..285: note = HLA-B (P30480) ECD

SEQ ID NO: 1342 - protein, 285 aa, synthetic construct; identical to SEQ ID NO: 1328
  REGION 1..285: note = HLA-B (P30481) ECD

SEQ ID NO: 1343 - protein, 285 aa, synthetic construct; identical to SEQ ID NO: 1328
  REGION 1..285: note = HLA-B (P30483) ECD

SEQ ID NO: 1344 - protein, 285 aa, synthetic construct; identical to SEQ ID NO: 1328
  REGION 1..285: note = HLA-B (P30484) ECD

SEQ ID NO: 1345 - protein, 285 aa, synthetic construct; identical to SEQ ID NO: 1328
  REGION 1..285: note = HLA-B (P30485) ECD

SEQ ID NO: 1346 - protein, 285 aa, synthetic construct; identical to SEQ ID NO: 1328
  REGION 1..285: note = HLA-B (P30486) ECD

SEQ ID NO: 1347 - protein, 285 aa, synthetic construct; identical to SEQ ID NO: 1328
  REGION 1..285: note = HLA-B (P30487) ECD

SEQ ID NO: 1348 - protein, 285 aa, synthetic construct; identical to SEQ ID NO: 1328
  REGION 1..285: note = HLA-B (P30488) ECD

SEQ ID NO: 1349 - protein, 285 aa, synthetic construct; identical to SEQ ID NO: 1328
  REGION 1..285: note = HLA-B (P30490) ECD

SEQ ID NO: 1350 - protein, 285 aa, synthetic construct; identical to SEQ ID NO: 1328
  REGION 1..285: note = HLA-B (P30491) ECD

SEQ ID NO: 1351 - protein, 285 aa, synthetic construct; identical to SEQ ID NO: 1328
  REGION 1..285: note = HLA-B (P30492) ECD

SEQ ID NO: 1352 - protein, 285 aa, synthetic construct; identical to SEQ ID NO: 1328
  REGION 1..285: note = HLA-B (P30493) ECD

SEQ ID NO: 1353 - protein, 285 aa, synthetic construct; identical to SEQ ID NO: 1328
  REGION 1..285: note = HLA-B (P30495) ECD

SEQ ID NO: 1354 - protein, 285 aa, synthetic construct; identical to SEQ ID NO: 1328
  REGION 1..285: note = HLA-B (P30498) ECD

SEQ ID NO: 1355 - protein, 285 aa, synthetic construct; identical to SEQ ID NO: 1328
  REGION 1..285: note = HLA-B (P30685) ECD

SEQ ID NO: 1356 - protein, 285 aa, synthetic construct; identical to SEQ ID NO: 1328
  REGION 1..285: note = HLA-B (Q04826) ECD

SEQ ID NO: 1357 - protein, 285 aa, synthetic construct; identical to SEQ ID NO: 1328
  REGION 1..285: note = HLA-B (Q29718) ECD

SEQ ID NO: 1358 - protein, 285 aa, synthetic construct; identical to SEQ ID NO: 1328
  REGION 1..285: note = HLA-B (Q29836) ECD

SEQ ID NO: 1359 - protein, 285 aa, synthetic construct; identical to SEQ ID NO: 1328
  REGION 1..285: note = HLA-B (Q29940) ECD

SEQ ID NO: 1360 - protein, 285 aa, synthetic construct; identical to SEQ ID NO: 1328
  REGION 1..285: note = HLA-B (Q31610) ECD

SEQ ID NO: 1361 - protein, 285 aa, synthetic construct; identical to SEQ ID NO: 1328
  REGION 1..285: note = HLA-B (Q31612) ECD

SEQ ID NO: 1362 - protein, 285 aa, synthetic construct; identical to SEQ ID NO: 1328
  REGION 1..285: note = HLA-B (Q95365) ECD

SEQ ID NO: 1363 - protein, 284 aa, synthetic construct
  REGION 1..284: note = HLA-C (P04222) ECD
CSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPI

SEQ ID NO: 1364 - protein, 284 aa, synthetic construct; identical to SEQ ID NO: 1363
  REGION 1..284: note = HLA-C (P10321) ECD

SEQ ID NO: 1365 - protein, 284 aa, synthetic construct; identical to SEQ ID NO: 1363
  REGION 1..284: note = HLA-C (P30499) ECD

SEQ ID NO: 1366 - protein, 284 aa, synthetic construct; identical to SEQ ID NO: 1363
  REGION 1..284: note = HLA-C (P30501) ECD

SEQ ID NO: 1367 - protein, 284 aa, synthetic construct; identical to SEQ ID NO: 1363
  REGION 1..284: note = HLA-C (P30504) ECD

SEQ ID NO: 1368 - protein, 284 aa, synthetic construct; identical to SEQ ID NO: 1363
  REGION 1..284: note = HLA-C (P30505) ECD

SEQ ID NO: 1369 - protein, 284 aa, synthetic construct; identical to SEQ ID NO: 1363
  REGION 1..284: note = HLA-C (P30508) ECD

SEQ ID NO: 1370 - protein, 284 aa, synthetic construct; identical to SEQ ID NO: 1363
  REGION 1..284: note = HLA-C (P30510) ECD

SEQ ID NO: 1371 - protein, 284 aa, synthetic construct; identical to SEQ ID NO: 1363
  REGION 1..284: note = HLA-C (Q07000) ECD

SEQ ID NO: 1372 - protein, 284 aa, synthetic construct; identical to SEQ ID NO: 1363
  REGION 1..284: note = HLA-C (Q29865) ECD

SEQ ID NO: 1373 - protein, 284 aa, synthetic construct; identical to SEQ ID NO: 1363
  REGION 1..284: note = HLA-C (Q29960) ECD

SEQ ID NO: 1374 - protein, 284 aa, synthetic construct; identical to SEQ ID NO: 1363
  REGION 1..284: note = HLA-C (Q29963) ECD

SEQ ID NO: 1375 - protein, 284 aa, synthetic construct; identical to SEQ ID NO: 1363
  REGION 1..284: note = HLA-C (Q95604) ECD

SEQ ID NO: 1376 - protein, 284 aa, synthetic construct; identical to SEQ ID NO: 1363
  REGION 1..284: note = HLA-C (Q9TNN7) ECD

SEQ ID NO: 1377 - protein, 207 aa, synthetic construct
  REGION 1..207: note = HLA-DMA (P28067) ECD
VPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWHDHSVPVEGFGPTFVSAVDGLSFQAFSYLNFTPEPSDIFSCIVTHEIDRYTAIAYWVPRNALPSDLLENVLC

SEQ ID NO: 1378 - protein, 200 aa, synthetic construct
  REGION 1..200: note = HLA-DMB (P28068) ECD
GGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLK

SEQ ID NO: 1379 - protein, 192 aa, synthetic construct
  REGION 1..192: note = HLA-DOA (P06340) ECD
TKADHMGSYGPAFYQSYGASGQFTHEFDEEQLFSVDLKKSEAVWRLPEFGDFARFDPQGGLAGIAAIKAHLDILVERSNRSRAINVPPRVTVLPKSRVELGQPNILICIVDNIFPPVINITWLRNGQTVTEGVAQTSFYSQPDHLFRKFHYLPFVPSAEDVYDCQVEHWGLDAPLLRHWELQVPIPPPDAME

SEQ ID NO: 1380 - protein, 198 aa, synthetic construct
  REGION 1..198: note = HLA-DOB (P13765) ECD
TDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRK

SEQ ID NO: 1381 - protein, 194 aa, synthetic construct
  REGION 1..194: note = HLA-DPA1 (P20036) ECD
AGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTE

SEQ ID NO: 1382 - protein, 196 aa, synthetic construct
  REGION 1..196: note = HLA-DPB1 (P04440) ECD
RATPENYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSK

SEQ ID NO: 1383 - protein, 193 aa, synthetic construct
  REGION 1..193: note = HLA-DQA1 (P01909) ECD
EDIVADHVASYGVNLYQSYGPSGQYTHEFDGDEQFYVDLGRKETVWCLPVLRQFRFDPQFALTNIAVLKHNLNSLIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTE

SEQ ID NO: 1384 - protein, 194 aa, synthetic construct
  REGION 1..194: note = HLA-DQA2 (P01906) ECD
EDIVADHVASYGVNFYQSHGPSGQYTHEFDGDEEFYVDLETKETVWQLPMFSKFISFDPQSALRNMAVGKHTLEFMMRQSNSTAATNEVPEVTVFSKFPVTLGQPNTLICLVDNIFPPVVNITWLSNGHSVTEGVSETSFLSKSDHSFFKISYLTFLPSADEIYDCKVEHWGLDEPLLKHWEPEIPAPMSELTE

SEQ ID NO: 1385 - protein, 198 aa, synthetic construct
  REGION 1..198: note = HLA-DQB1 (P01920) ECD
RDSPEDFVYQFKAMCYFTNGTERVRYVTRYIYNREEYARFDSDVEVYRAVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQHGDVYTCHVEHPSLQNPITVEWRAQSESAQSK

SEQ ID NO: 1386 - protein, 197 aa, synthetic construct
  REGION 1..197: note = HLA-DQB2 (P05538) ECD
RDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRAQSESAQSK

SEQ ID NO: 1387 - protein, 191 aa, synthetic construct
  REGION 1..191: note = HLA-DRA (P01903) ECD
IKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTE

SEQ ID NO: 1388 - protein, 198 aa, synthetic construct
  REGION 1..198: note = HLA-DRB1 (P01911) ECD
GDTRPRFLWQPKRECHFFNGTERVRFLDRYFYNQEESVRFDSDVGEFRAVTELGRPDAEYWNSQKDILEQARAAVDTYCRHNYGVVESFTVQRRVQPKVTVYPSKTQPLQHHNLLVCSVSGFYPGSIEVRWFLNGQEEKAGMVSTGLIQNGDWTFQTLVMLETVPRSGEVYTCQVEHPSVTSPLTVEWRARSESAQSK

SEQ ID NO: 1389 - protein, 198 aa, synthetic construct
  REGION 1..198: note = HLA-DRB3 (P79483) ECD
GDTRPRFLELRKSECHFFNGTERVRYLDRYFHNQEEFLRFDSDVGEYRAVTELGRPVAESWNSQKDLLEQKRGRVDNYCRHNYGVGESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSALTVEWRARSESAQSK

SEQ ID NO: 1390 - protein, 198 aa, synthetic construct
  REGION 1..198: note = HLA-DRB4 (P13762) ECD
GDTQPRFLEQAKCECHFLNGTERVWNLIRYIYNQEEYARYNSDLGEYQAVTELGRPDAEYWNSQKDLLERRRAEVDTYCRYNYGVVESFTVQRRVQPKVTVYPSKTQPLQHHNLLVCSVNGFYPGSIEVRWFRNGQEEKAGVVSTGLIQNGDWTFQTLVMLETVPRSGEVYTCQVEHPSMMSPLTVQWSARSESAQSK

SEQ ID NO: 1391 - protein, 198 aa, synthetic construct
  REGION 1..198: note = HLA-DRB5 (Q30154) ECD
GDTRPRFLQQDKYECHFFNGTERVRFLHRDIYNQEEDLRFDSDVGEYRAVTELGRPDAEYWNSQKDFLEDRRAAVDTYCRHNYGVGESFTVQRRVEPKVTVYPARTQTLQHHNLLVCSVNGFYPGSIEVRWFRNSQEEKAGVVSTGLIQNGDWTFQTLVMLETVPRSGEVYTCQVEHPSVTSPLTVEWRAQSESAQSK

SEQ ID NO: 1392 - protein, 284 aa, synthetic construct
  REGION 1..284: note = HLA-E (P13747) ECD
GSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPDGRFLRGYEQFAYDGKDYLTLNEDLRSWTAVDTAAQISEQKSNDASEAEHQRAYLEDTCVEWLHKYLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWKPASQPTIPI

SEQ ID NO: 1393 - protein, 284 aa, synthetic construct
  REGION 1..284: note = HLA-F (P30511) ECD
GSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPPGEEQRYTCHVQHEGLPQPLILRWEQSPQPTIPI

SEQ ID NO: 1394 - protein, 284 aa, synthetic construct [sequence omitted]

SEQ ID NO: 1395 - protein, 284 aa, synthetic construct
  REGION 1..284: note = HLA-H (P01893) ECD
RSHSMRYFYTTMSRPGAGEPRFISVGYVDDTQFVRFDSDDASPREEPRAPWMEREGPKYWDRNTQICKAQAQTERENLRIALRYYNQSEGGSHTMQVMYGCDVGPDGPFLRGYEQHAYDGKDYIALNEDLRSWTAADMAAQITKRKWEAARRAEQRRVYLEGEFVEWLRRYLENGKETLQRADPPKTHMTHHPISDHEATLRCWALGFYPAEITLTWQRDGEDQTQDTELVETRPAGDGTFQKWAAVVVPSGEEQRYTCHVQHEGLPEPLTLRWEPSSQPTVPI

SEQ ID NO: 1396 - protein, 453 aa, synthetic construct
  REGION 1..453: note = ICAM1 (P05362) ECD
QTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYE

SEQ ID NO: 1397 - protein, 199 aa, synthetic construct
  REGION 1..199: note = ICAM2 (P13598) ECD
KVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQ

SEQ ID NO: 1398 - protein, 456 aa, synthetic construct
  REGION 1..456: note = ICAM3 (P32942) ECD
QEFLLRVEPQNPVLSAGGSLFVNCSTDCPSSEKIALETSLSKELVASGMGWAAFNLSNVTGNSRILCSVYCNGSQITGSSNITVYRLPERVELAPLPPWQPVGQNFTLRCQVEDGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSH

SEQ ID NO: 1399 - protein, 218 aa, synthetic construct
  REGION 1..218: note = ICAM4 (Q14773) ECD
ALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLAWSPAPTA

SEQ ID NO: 1400 - protein, 804 aa, synthetic construct
  REGION 1..804: note = ICAM5 (Q9UMF0) ECD
EPFWADLQPRVAFVERGGSLWLNCSTNCPRPERGGLETSLRRNGTQRGLRWLARQLVDIREPETQPVCFFRCARRTLQARGLIRTFQRPDRVELMPLPPWQPVGENFTLSCRVPGAGPRASLTLTLLRGAQELIRRSFAGEPPRARGAVLTATVLARREDHGANFSCRAELDLRPHGLGLFENSSAPRELRTFSLSPDAPRLAAPRLLEVGSERPVSCTLDGLFPASEARVYLALGDQNLSPDVTLEGDAFVATATATASAEQEGARQLVCNVTLGGENRETRENVTIYSFPAPLLTLSEPSVSEGQMVTVTCAAGAQALVTLEGVPAAVPGQPAQLQLNATENDDRRSFFCDATLDVDGETLIKNRSAELRVLYAPRLDDSDCPRSWTWPEGPEQTLRCEARGNPEPSVHCARSDGGAVLALGLLGPVTRALSGTYRCKAANDQGEAVKDVTLTVEYAPALDSVGCPERITWLEGTEASLSCVAHGVPPPDVICVRSGELGAVIEGLLRVAREHAGTYRCEATNPRGSAAKNVAVTVEYGPRFEEPSCPSNWTWVEGSGRLFSCEVDGKPQPSVKCVGSGGATEGVLLPLAPPDPSPRAPRIPRVLAPGIYVCNATNRHGSVAKTVVVSAESPPEMDESTCPSHQTWLEGAEASALACAARGRPSPGVRCSREGIPWPEQQRVSREDAGTYHCVATNAHGTDSRTVTVGVEYRPVVAELAASPPGGVRPGGNFTLTCRAEAWPPAQISWRAPPGALNIGLSSNNSTLSVAGAMGSHGGEYECAATNAHGRHARRITVRVAGPW

SEQ ID NO: 1401 - protein, 120 aa, synthetic construct
  REGION 1..120: note = ICOS (Q9Y6W8) ECD
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLK

SEQ ID NO: 1402 - protein, 238 aa, synthetic construct [sequence omitted]

SEQ ID NO: 1403 - protein, 409 aa, synthetic construct
  REGION 1..409: note = IFNAR1 (P17181) ECD
KNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSK

SEQ ID NO: 1404 - protein, 217 aa, synthetic construct
  REGION 1..217: note = IFNAR2 (P48551) ECD
ISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAK

SEQ ID NO: 1405 - protein, 228 aa, synthetic construct [sequence omitted]

SEQ ID NO: 1406 - protein, 220 aa, synthetic construct
  REGION 1..220: note = IFNGR2 (P38484) ECD
SQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQ

SEQ ID NO: 1407 - protein, 208 aa, synthetic construct
  REGION 1..208: note = IFNLR1 (Q8IU57) ECD
RPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWA

SEQ ID NO: 1408 - protein, 605 aa, synthetic construct
  REGION 1..605: note = IGDCC3 (Q8IVU1) ECD
LGHSAELAFAVEPSDDVAVPGQPIVLDCRVEGTPPVRITWRKNGVELPESTHSTLLANGSLMIRHFRLEPGGSPSDEGDYECVAQNRFGLVVSRKARIQAATMSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECVATGNPRPIVSWSRLDGRPIGVEGIQVLGTGNLIISDVTVQHSGVYVCAANRPGTRVRRTAQGRLVVQAPAEFVQHPQSISRPAGTTAMFTCQAQGEPPPHVTWLKNGQVLGPGGHVRLKNNNSTLTISGIGPEDEAIYQCVAENSAGSSQASARLTVLWAEGLPGPPRNVRAVSVSSTEVRVSWSEPLANTKEIIGYVLHIRKAADPPELEYQEAVSKSTFQHLVSDLEPSTAYSFYIKAYTPRGASSASVPTLASTLGEAPAPPPLSVRVLGSSSLQLLWEPWPRLAQHEGGFKLFYRPASKTSFTGPILLPGTVSSYNLSQLDPTAVYEVKLLAYNQHGDGNATVRFVSLRGASERTALSPPCDCRKEEAANQTSTTG

SEQ ID NO: 1409 - protein, 933 aa, synthetic construct
  REGION 1..933: note = IGDCC4 (Q8TDY8) ECD
ELLLPQETTVELSCGVGPLQVILGPEQAAVLNCSLGAAAAGPPTRVTWSKDGDTLLEHDHLHLLPNGSLWLSQPLAPNGSDESVPEAVGVIEGNYSCLAHGPLGVLASQTAVVKLATLADFSLHPESQTVEENGTARFECHIEGLPAPIITWEKDQVTLPEEPRLIVLPNGVLQILDVQESDAGPYRCVATNSARQHFSQEALLSVAHRGSLASTRGQDVVIVAAPENTTVVSGQSVVMECVASADPTPFVSWVRQDGKPISTDVIVLGRTNLLIANAQPWHSGVYVCRANKPRTRDFATAAAELRVLAAPAITQAPEALSRTRASTARFVCRASGEPRPALRWLHNGAPLRPNGRVKVQGGGGSLVITQIGLQDAGYYQCVAENSAGMACAAASLAVVVREGLPSAPTRVTATPLSSSAVLVAWERPEMHSEQIIGFSLHYQKARGMDNVEYQFAVNNDTTELQVRDLEPNTDYEFYVVAYSQLGASRTSTPALVHTLDDVPSAAPQLSLSSPNPSDIRVAWLPLPPSLSNGQVVKYKIEYGLGKEDQIFSTEVRGNETQLMLNSLQPNKVYRVRISAGTAAGFGAPSQWMHHRTPSMHNQSHVPFAPAELKVQAKMESLVVSWQPPPHPTQISGYKLYWREVGAEEEANGDRLPGGRGDQAWDVGPVRLKKKVKQYELTQLVPGRLYEVKLVAFNKHEDGYAAVWKGKTEKAPAPDMPIQRGPPLPPAHVHAESNSSTSIWLRWKKPDFTTVKIVNYTVRFSPWGLRNASLVTYYTSSGEDILIGGLKPFTKYEFAVQSHGVDMDGPFGSVVERSTLPDRPSTPPSDLRLSPLTPSTVRLHWCPPTEPNGEIVEYLILYSSNHTQPEHQWTLLTTQGNIFSAEVHGLESDTRYFFKMGARTEVGPGPFSRLQDVITLQEKLSDSLDMHSVT

SEQ ID NO: 1410 - protein, 195 aa, synthetic construct
  REGION 1..195: note = IGF1R (P08069) ECD
DVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIH

SEQ ID NO: 1411 - protein, 2264 aa, synthetic construct
  REGION 1..2264: note = IGF2R (P11717) ECD
QAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEARPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQ

SEQ ID NO: 1412 - protein, 141 aa, synthetic construct
  REGION 1..141: note = IGFLR1 (Q9H665) ECD
SQYCGRLEYWNPDNKCCSSCLQRFGPPPCPDYEFRENCGLNDHGDFVTPPFRKCSSGQCNPDGAELCSPCGGGAVTPTPAAGGGRTPWRCRERPVPAKGHCPLTPGNPGAPSSQERSSPASSIAWRTPEPVPQQAWPNFLP

SEQ ID NO: 1413 - protein, 219 aa, synthetic construct
  REGION 1..219: note = IGSF11 (Q5DX21) ECD
LEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIG

SEQ ID NO: 1414 - protein, 1105 aa, synthetic construct
  REGION 1..1105: note = IGSF3 (O75054) ECD
QRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLKSSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDA

SEQ ID NO: 1415 - protein, 126 aa, synthetic construct
  REGION 1..126: note = IGSF6 (O95976) ECD
CTLSVTQPWYLEVDYTHEAVTIKCTFSATGCPSEQPTCLWFRYGAHQPENLCLDGCKSEADKFTVREALKENQVSLTVNRVTSNDSAIYICGIAFPSVPEARAKQTGGGTTLVVREIKLLSKELRS

SEQ ID NO: 1416 - protein, 552 aa, synthetic construct
  REGION 1..552: note = IGSF8 (Q969P0) ECD
REVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDT

SEQ ID NO: 1417 - protein, 714 aa, synthetic construct
  REGION 1..714: note = IGSF9 (Q9P2J2) ECD
RGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQP

SEQ ID NO: 1418 - protein, 702 aa, synthetic construct
  REGION 1..702: note = IGSF9B (Q9UPX0) ECD
EGAHGLREEPEFVTARAGESVVLRCDVIHPVTGQPPPYVVEWFKFGVPIPIFIKFGYYPPHVDPEYAGRASLHDKASLRLEQVRSEDQGWYECKVLMLDQQYDTFHNGSWVHLTINAPPTFTETPPQYIEAKEGGSITMTCTAFGNPKPIVTWLKEGTLLGASGKYQVSDGSLTVTSVSREDRGAYTCRAYSIQGEAVHTTHLLVQGPPFIVSPPENITVNISQDALLTCRAEAYPGNLTYTWYWQDENVYFQNDLKLRVRILIDGTLIIFRVKPEDSGKYTCVPSNSLGRSPSASAYLTVQYPARVLNMPPVIYVPVGIHGYIRCPVDAEPPATVVKWNKDGRPLQVEKNLGWTLMEDGSIRIEEATEEALGTYTCVPYNTLGTMGQSAPARLVLKDPPYFTVLPGWEYRQEAGRELLIPCAAAGDPFPVITWRKVGKPSRSKHSALPSGSLQFRALSKEDHGEWECVATNVVTSITASTHLTVIGTSPHAPGSVRVQVSMTTANVSWEPGYDGGYEQTFSVWMKRAQFGPHDWLSLPVPPGPSWLLVDTLEPETAYQFSVLAQNKLGTSAFSEVVTVNTLAFPITTPEPLVLVTPPRCLIANRTQQGVLLSWLPPANHSFPIDRYIMEFRVAERWELLDDGIPGTEGEFFAKDLSQDTWYEFRVLAVMQDLISEPSNIAGVSSTDIFPQPDLTEDGLARP

SEQ ID NO: 1419 - protein, 214 aa, synthetic construct
  REGION 1..214: note = IL10RA (Q13651) ECD
HGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTN

SEQ ID NO: 1420 - protein, 201 aa, synthetic construct
  REGION 1..201: note = IL10RB (Q08334) ECD
MVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPS

SEQ ID NO: 1421 - protein, 347 aa, synthetic construct
  REGION 1..347: note = IL11RA (Q14626) ECD
SPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLA

SEQ ID NO: 1422 - protein, 522 aa, synthetic construct
  REGION 1..522: note = IL12RB1 (P42701) ECD
CRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSD

SEQ ID NO: 1423 - protein, 599 aa, synthetic construct
  REGION 1..599: note = IL12RB2 (Q99665) ECD
KIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKAN

SEQ ID NO: 1424 - protein, 322 aa, synthetic construct
  REGION 1..322: note = IL13RA1 (P78552) ECD
GGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNST

SEQ ID NO: 1425 - protein, 317 aa, synthetic construct
  REGION 1..317: note = IL13RA2 (Q14627) ECD
DTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLR

SEQ ID NO: 1426 - protein, 175 aa, synthetic construct
  REGION 1..175: note = IL15RA (Q13261) ECD
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 1427 - protein, 288 aa, synthetic construct
  REGION 1..288: note = IL17RA (Q96F46) ECD
LRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLW

SEQ ID NO: 1428 - protein, 275 aa, synthetic construct
  REGION 1..275: note = IL17RB (Q9NRM6) ECD
REPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLP

SEQ ID NO: 1429 - protein, 518 aa, synthetic construct
  REGION 1..518: note = IL17RC (Q8NAC3) ECD
LERLVGPQDATHCSPVSLEPWGDEERLRVQFLAQQSLSLAPVTAATARTALSGLSGADGRREERGRGKSWVCLSLGGSGNTEPQKKGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKR

SEQ ID NO: 1430 - protein, 283 aa, synthetic construct
  REGION 1..283: note = IL17RD (Q8NFM7) ECD
CLNGSQLAVAAGGSGRARGADTCGWRGVGPASRNSGLYNITFKYDNCTTYLNPVGKHVIADAQNITISQYACHDQVAVTILWSPGALGIEFLKGFRVILEELKSEGRQCQQLILKDPKQLNSSFKRTGMESQPFLNMKFETDYFVKVVPFPSIKNESNYHPFFFRTRACDLLLQPDNLACKPFWKPRNLNISQHGSDMQVSFDHAPHNFGFRFFYLHYKLKHEGPFKRKTCKQEQTTETTSCLLQNVSPGDYIIELVDDTNTTRKVMHYALKPVHSPWAGPIR

SEQ ID NO: 1431 - protein, 431 aa, synthetic construct
  REGION 1..431: note = IL17RE (Q8NFR9) ECD
AGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRH

SEQ ID NO: 1432 - protein, 308 aa, synthetic construct
  REGION 1..308: note = IL18R1 (Q13478) ECD
CTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKADMADIPGHVFTR

SEQ ID NO: 1433 - protein, 337 aa, synthetic construct
  REGION 1..337: note = IL18RAP (O95256) ECD
FNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHFLTPGVNNSGSYICRPKMIKSPYDVACCVKMILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKR

SEQ ID NO: 1434 - protein, 319 aa, synthetic construct
  REGION 1..319: note = IL1R1 (P14778) ECD
LEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQK

SEQ ID NO: 1435 - protein, 330 aa, synthetic construct
  REGION 1..330: note = IL1R2 (P27930) ECD
FTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKE

SEQ ID NO: 1436 - protein, 347 aa, synthetic construct
  REGION 1..347: note = IL1RAP (Q9NPH3) ECD
SERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVELACGFGAT

SEQ ID NO: 1437 - protein, 339 aa, synthetic construct
  REGION 1..339: note = IL1RAPL1 (Q9NZN1) ECD
LKVVTKRGSADGCTDWSIDIKKYQVLVGEPVRIKCALFYGYIRTNYSLAQSAGLSLMWYKSSGPGDFEEPIAFDGSRMSKEEDSIWFRPTLLQDSGLYACVIRNSTYCMKVSISLTVGENDTGLCYNSKMKYFEKAELSKSKEISCRDIEDFLLPTREPEILWYKECRTKTWRPSIVFKRDTLLIREVREDDIGNYTCELKYGGFVVRRTTELTVTAPLTDKPPKLLYPMESKLTIQETQLGDSANLTCRAFFGYSGDVSPLIYWMKGEKFIEDLDENRVWESDIRILKEHLGEQEVSISLIVDSVEEGDLGNYSCYVENGNGRRHASVLLHKRELMYT

SEQ ID NO: 1438 - protein, 338 aa, synthetic construct
  REGION 1..338: note = IL1RAPL2 (Q9NP60) ECD
TNLKMVSKRNSVDGCIDWSVDLKTYMALAGEPVRVKCALFYSYIRTNYSTAQSTGLRLMWYKNKGDLEEPIIFSEVRMSKEEDSIWFHSAEAQDSGFYTCVLRNSTYCMKVSMSLTVAENESGLCYNSRIRYLEKSEVTKRKEISCPDMDDFKKSDQEPDVVWYKECKPKMWRSIIIQKGNALLIQEVQEEDGGNYTCELKYEGKLVRRTTELKVTALLTDKPPKPLFPMENQPSVIDVQLGKPLNIPCKAFFGFSGESGPMIYWMKGEKFIEELAGHIREGEIRLLKEHLGEKEVELALIFDSVVEADLANYTCHVENRNGRKHASVLLRKKDLIYK

SEQ ID NO: 1439 - protein, 310 aa, synthetic construct
  REGION 1..310: note = IL1RL1 (Q01638) ECD
KFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPIDHHS

SEQ ID NO: 1440 - protein, 316 aa, synthetic construct
  REGION 1..316: note = IL1RL2 (Q9HB29) ECD
DGCKDIFMKNEILSASQPFAFNCTFPPITSGEVSVTWYKNSSKIPVSKIIQSRIHQDETWILFLPMEWGDSGVYQCVIKGRDSCHRIHVNLTVFEKHWCDTSIGGLPNLSDEYKQILHLGKDDSLTCHLHFPKSCVLGPIKWYKDCNEIKGERFTVLETRLLVSNVSAEDRGNYACQAILTHSGKQYEVLNGITVSITERAGYGGSVPKIIYPKNHSIEVQLGTTLIVDCNVTDTKDNTNLRCWRVNNTLVDDYYDESKRIREGVETHVSFREHNLYTVNITFLEVKMEDYGLPFMCHAGVSTAYIILQLPAPDFR

SEQ ID NO: 1441 - protein, 221 aa, synthetic construct
  REGION 1..221: note = IL20RA (Q9UHF4) ECD
VPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAK

SEQ ID NO: 1442 - protein, 204 aa, synthetic construct
  REGION 1..204: note = IL20RB (Q6UXL0) ECD
DEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPL

SEQ ID NO: 1443 - protein, 213 aa, synthetic construct
  REGION 1..213: note = IL21R (Q9HBE5) ECD
CPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKE

SEQ ID NO: 1444 - protein, 213 aa, synthetic construct
  REGION 1..213: note = IL22RA1 (Q8N6P7) ECD
HAPEDPSDLLQHVKFQSSNFENILTWDSGPEGTPDTVYSIEYKTYGERDWVAKKGCQRITRKSCNLTVETGNLTELYYARVTAVSAGGRSATKMTDRFSSLQHTTLKPPDVTCISKVRSIQMIVHPTPTPIRAGDGHRLTLEDIFHDLFYHLELQVNRTYQMHLGGKQREYEFFGLTPDTEFLGTIMICVPTWAKESAPYMCRVKTLPDRTWT

SEQ ID NO: 1445 - protein, 332 aa, synthetic construct; identical to SEQ ID NO: 874
  REGION 1..332: note = IL23R (Q5VWK5) ECD

SEQ ID NO: 1446 - protein, 484 aa, synthetic construct
  REGION 1..484: note = IL27RA (Q6UWB1) ECD
QGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSVAVSSIAGSTELLVTWQPGPGEPLEHVVDWARDGDPLEKLNWVRLPPGNLSALLPGNFTVGVPYRITVTAVSASGLASASSVWGFREELAPLVGPTLWRLQDAPPGTPAIAWGEVPRHQLRGHLTHYTLCAQSGTSPSVCMNVSGNTQSVTLPDLPWGPCELWVTASTIAGQGPPGPILRLHLPDNTLRWK

SEQ ID NO: 1447 - protein, 219 aa, synthetic construct
  REGION 1..219: note = IL2RA (P01589) ECD
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 1448 - protein, 214 aa, synthetic construct
  REGION 1..214: note = IL2RB (P14784) ECD
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 1449 - protein, 240 aa, synthetic construct
  REGION 1..240: note = IL2RG (P31785) ECD
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEA

SEQ ID NO: 1450 - protein, 500 aa, synthetic construct
  REGION 1..500: note = IL31RA (Q8NI17) ECD
ALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFE

SEQ ID NO: 1451 - protein, 287 aa, synthetic construct
  REGION 1..287: note = IL3RA (P26951) ECD
TKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWR

SEQ ID NO: 1452 - protein, 207 aa, synthetic construct
  REGION 1..207: note = IL4R (P24394) ECD
MKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQH

SEQ ID NO: 1453 - protein, 322 aa, synthetic construct
  REGION 1..322: note = IL5RA (Q01344) ECD
DLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREW

SEQ ID NO: 1454 - protein, 346 aa, synthetic construct
  REGION 1..346: note = IL6R (P08887) ECD
LAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLP

SEQ ID NO: 1455 - protein, 597 aa, synthetic construct
  REGION 1..597: note = IL6ST (P40189) ECD
ELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIE

SEQ ID NO: 1456 - protein, 219 aa, synthetic construct
  REGION 1..219: note = IL7R (P16871) ECD
ESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMD

SEQ ID NO: 1457 - protein, 230 aa, synthetic construct; identical to SEQ ID NO: 856
  REGION 1..230: note = IL9R (Q01113) ECD

SEQ ID NO: 1458 - protein, 144 aa, synthetic construct
  REGION 1..144: note = ILDR1 (Q86SU0) ECD
LLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLVINEVMWWDHGVYYCTIEAPGDTSGDPDKEVKLIVLH

SEQ ID NO: 1459 - protein, 1077 aa, synthetic construct
  REGION 1..1077: note = IMPG2 (Q9BZV3) ECD
DFPSLTAQTYLSIEEIQEPKSAVSFLLPEESTDLSLATKKKQPLDRRETERQWLIRRRRSILFPNGVKICPDESVAEAVANHVKYFKVRVCQEAVWEAFRTFWDRLPGREEYHYWMNLCEDGVTSIFEMGTNFSESVEHRSLIMKKLTYAKETVSSSELSSPVPVGDTSTLGDTTLSVPHPEVDAYEGASESSLERPEESISNEIENVIEEATKPAGEQIAEFSIHLLGKQYREELQDSSSFHHQHLEEEFISEVENAFTGLPGYKEIRVLEFRSPKENDSGVDVYYAVTFNGEAISNTTWDLISLHSNKVENHGLVELDDKPTVVYTISNFRDYIAETLQQNFLLGNSSLNPDPDSLQLINVRGVLRHQTEDLVWNTQSSSLQATPSSILDNTFQAAWPSADESITSSIPPLDFSSGPPSATGRELWSESPLGDLVSTHKLAFPSKMGLSSSPEVLEVSSLTLHSVTPAVLQTGLPVASEERTSGSHLVEDGLANVEESEDFLSIDSLPSSSFTQPVPKETIPSMEDSDVSLTSSPYLTSSIPFGLDSLTSKVKDQLKVSPFLPDASMEKELIFDGGLGSGSGQKVDLITWPWSETSSEKSAEPLSKPWLEDDDSLLPAEIEDKKLVLVDKMDSTDQISKHSKYEHDDRSTHFPEEEPLSGPAVPIFADTAAESASLTLPKHISEVPGVDDYSVTKAPLILTSVAISASTDKSDQADAILREDMEQITESSNYEWFDSEVSMVKPDMQTLWTILPESERVWTRTSSLEKLSRDILASTPQSADRLWLSVTQSTKLPPTTISTLLEDEVIMGVQDISLELDRIGTDYYQPEQVQEQNGKVGSYVEMSTSVHSTEMVSVAWPTEGGDDLSYTQTSGALVVFFSLRVTNMMFSEDLFNKNSLEYKALEQRFLELLVPYLQSNLTGFQNLEILNFRNGSIVVNSRMKFANSVPPNVNNAVYMILEDFCTTAYNTMNLAIDKYSLDVESGDEANPCKFQACNEFSECLVNPWSGEAKCRCFPGYLSVEERPCQSLCDLQPDFCLNDGKCDIMPGHGAICRCRVGENWWYRGKHCEEFVSEP

SEQ ID NO: 1460 - protein, 929 aa, synthetic construct
  REGION 1..929: note = INSR (P06213) ECD
HLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAK

SEQ ID NO: 1461 - protein, 175 aa, synthetic construct
  REGION 1..175: note = INSRR (P14616) ECD
AAGPLRLGGNSSDFEIQEDKVPRERAVLSGLRHFTEYRIDIHACNHAAHTVGCSAATFVFARTMPHREADGIPGKVAWEASSKNSVLLRWLEPPDPNGLILKYEIKYRRLGEEATVLCVSRLRYAKFGGVHLALLPPGNYSARVRATSLAGNGSWTDSVAFYILGPEEEDAGGLH

SEQ ID NO: 1462 - protein, 571 aa, synthetic construct
  REGION 1..571: note = ISLR2 (Q6UXK2) ECD
SCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLRTLAPGTFDALSALSHLQLYHNPFHCGCGLVWLQAWAASTRVSLPEPDSIACASPPALQGVPVYRLPALPCAPPSVHLSAEPPLEAPGTPLRAGLAFVLHCIADGHPTPRLQWQLQIPGGTVVLEPPVLSGEDDGVGAEEGEGEGDGDLLTQTQAQTPTPAPAWPAPPATPRFLALANGSLLVPLLSAKEAGVYTCRAHNELGANSTSIRVAVAATGPPKHAPGAGGEPDGQAPTSERKSTAKGRGNSVLPSKPEGKIKGQGLAKVSILGETETEPEEDTSEGEEAEDQILADPAEEQRCGNGDPSRYVSNHAFNQSAELKPHVFELGVIALDVAEREARVQLTPLAARWGPGPGGAGGAPRPGRRPLRLLYLCPAGGGAAVQWSRVEEGVNAYWFRGLRPGTNYSVCLALAGEACHVQVVFSTKKELPS

SEQ ID NO: 1463 - protein, 533 aa, synthetic construct
  REGION 1..533: note = ITFG1 (Q8TB96) ECD
LHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNI

SEQ ID NO: 1464 - protein, 1113 aa, synthetic construct
  REGION 1..1113: note = ITGA1 (P56199) ECD
FNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVP

SEQ ID NO: 1465 - protein, 1100 aa, synthetic construct
  REGION 1..1100: note = ITGA10 (O75578) ECD
FNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMACAPLWSRACGSSVFSSGICARVDASFQPQGSLAPTAQRCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILIS

SEQ ID NO: 1466 - protein, 1119 aa, synthetic construct
  REGION 1..1119: note = ITGA11 (Q9UKX5) ECD
FNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVP

SEQ ID NO: 1467 - protein, 1103 aa, synthetic construct
  REGION 1..1103: note = ITGA2 (P17301) ECD
YNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKKGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPT

SEQ ID NO: 1468 - protein, 962 aa, synthetic construct
  REGION 1..962: note = ITGA2B (P08514) ECD
LNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRGEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEER

SEQ ID NO: 1469 - protein, 959 aa, synthetic construct
  REGION 1..959: note = ITGA3 (P26006) ECD
FNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIE

SEQ ID NO: 1470 - protein, 943 aa, synthetic construct
  REGION 1..943: note = ITGA4 (P13612) ECD
NVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVRFLSKTDKRLLYCIKADPHCLNFLCNFGKMESGKEASVHIQLEGRPSILEMDETSALKFEIRATGFPEPNPRVIELNKDENVAHVLLEGLHHQRPKRYFT

SEQ ID NO: 1471 - protein, 954 aa, synthetic construct
  REGION 1..954: note = ITGA5 (P08648) ECD
FNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSY

SEQ ID NO: 1472 - protein, 1027 aa, synthetic construct
  REGION 1..1027: note = ITGA6 (P23229) ECD
FNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYS

SEQ ID NO: 1473 - protein, 1049 aa, synthetic construct
  REGION 1..1049: note = ITGA7 (Q13683) ECD
FNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPW

SEQ ID NO: 1474 - protein, 974 aa, synthetic construct [sequence omitted]

SEQ ID NO: 1475 - protein, 952 aa, synthetic construct
  REGION 1..952: note = ITGA9 (Q13797) ECD
YNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGW

SEQ ID NO: 1476 - protein, 1082 aa, synthetic construct
  REGION 1..1082: note = ITGAD (Q13349) ECD
FNLDVEEPTIFQEDAGGFGQSVVQFGGSRLVVGAPLEVVAANQTGRLYDCAAATGMCQPIPLHIRPEAVNMSLGLTLAASTNGSRLLACGPTLHRVCGENSYSKGSCLLLGSRWEIIQTVPDATPECPHQEMDIVFLIDGSGSIDQNDFNQMKGFVQAVMGQFEGTDTLFALMQYSNLLKIHFTFTQFRTSPSQQSLVDPIVQLKGLTFTATGILTVVTQLFHHKNGARKSAKKILIVITDGQKYKDPLEYSDVIPQAEKAGIIRYAIGVGHAFQGPTARQELNTISSAPPQDHVFKVDNFAALGSIQKQLQEKIYAVEGTQSRASSSFQHEMSQEGFSTALTMDGLFLGAVGSFSWSGGAFLYPPNMSPTFINMSQENVDMRDSYLGYSTELALWKGVQNLVLGAPRYQHTGKAVIFTQVSRQWRKKAEVTGTQIGSYFGASLCSVDVDSDGSTDLILIGAPHYYEQTRGGQVSVCPLPRGRVQWQCDAVLRGEQGHPWGRFGAALTVLGDVNEDKLIDVAIGAPGEQENRGAVYLFHGASESGISPSHSQRIASSQLSPRLQYFGQALSGGQDLTQDGLMDLAVGARGQVLLLRSLPVLKVGVAMRFSPVEVAKAVYRCWEEKPSALEAGDATVCLTIQKSSLDQLGDIQSSVRFDLALDPGRLTSRAIFNETKNPTLTRRKTLGLGIHCETLKLLLPDCVEDVVSPIILHLNFSLVREPIPSPQNLRPVLAVGSQDLFTASLPFEKNCGQDGLCEGDLGVTLSFSGLQTLTVGSSLELNVIVTVWNAGEDSYGTVVSLYYPAGLSHRRVSGAQKQPHQSALRLACETVPTEDEGLRSSRCSVNHPIFHEGSNGTFIVTFDVSYKATLGDRMLMRASASSENNKASSSKATFQLELPVKYAVYTMISRQEESTKYFNFATSDEKKMKEAEHRYRVNNLSQRDLAISINFWVPVLLNGVAVWDVVMEAPSQSLPCVSERKPPQHSDFLTQISRSPMLDCSIADCLQFRCDVPSFSVQEELDFTLKGNLSFGWVRETLQKKVLVVSVAEITFDTSVYSQLPGQEAFMRAQMEMVLEEDEVYN

SEQ ID NO: 1477 - protein, 1106 aa, synthetic construct
  REGION 1..1106: note = ITGAE (P38570) ECD
FNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYIAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVVAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHS

SEQ ID NO: 1478 - protein, 1065 aa, synthetic construct
  REGION 1..1065: note = ITGAL (P20701) ECD
YNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAQGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQML

SEQ ID NO: 1479 - protein, 1088 aa, synthetic construct
  REGION 1..1088: note = ITGAM (P11215) ECD
FNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPN

SEQ ID NO: 1480 - protein, 962 aa, synthetic construct
  REGION 1..962: note = ITGAV (P06756) ECD
FNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPV

SEQ ID NO: 1481 - protein, 1088 aa, synthetic construct
  REGION 1..1088: note = ITGAX (P20702) ECD
FNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTP

SEQ ID NO: 1482 - protein, 708 aa, synthetic construct
  REGION 1..708: note = ITGB1 (P05556) ECD
QTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPD

SEQ ID NO: 1483 - protein, 678 aa, synthetic construct
  REGION 1..678: note = ITGB2 (P05107) ECD
QECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVQLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPN

SEQ ID NO: 1484 - protein, 692 aa, synthetic construct
  REGION 1..692: note = ITGB3 (P05106) ECD
GPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPD

SEQ ID NO: 1485 - protein, 683 aa, synthetic construct
  REGION 1..683: note = ITGB4 (P16144) ECD
NRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGS

SEQ ID NO: 1486 - protein, 696 aa, synthetic construct
  REGION 1..696: note = ITGB5 (P18084) ECD
GLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPN

SEQ ID NO: 1487 - protein, 688 aa, synthetic construct
  REGION 1..688: note = ITGB6 (P18564) ECD
GCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIP

SEQ ID NO: 1488 - protein, 704 aa, synthetic construct
  REGION 1..704: note = ITGB7 (P26010) ECD
ELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADH

SEQ ID NO: 1489 - protein, 642 aa, synthetic construct
  REGION 1..642: note = ITGB8 (P26012) ECD
EDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLR

SEQ ID NO: 1490 - protein, 271 aa, synthetic construct
  REGION 1..271: note = IZUMO1 (Q8IYV9) ECD
CVICDPSVVLALKSLEKDYLPGHLDAKHHKAMMERVENAVKDFQELSLNEDAYMGVVDEATLQKGSWSLLKDLKRITDSDVKGDLFVKELFWMLHLQKETFATYVARFQKEAYCPNKCGVMLQTLIWCKNCKKEVHACRKSYDCGERNVEVPQMEDMILDCELNWHQASEGLTDYSFYRVWGNNTETLVSKGKEATLTKPMVGPEDAGSYRCELGSVNSSPATIINFHVTVLPKMIKEEKPSPNIVTPGEATTESSISLQPLQPEKMLASR

SEQ ID NO: 1491 - protein, 154 aa, synthetic construct
  REGION 1..154: note = IZUMO3 (Q5VZ72) ECD
CLECDPKFIEDVGSLLGNLIPSEVPGRTQLLERQIKEMIHLSFKVSHSDKRLRVLAVQQVVKLRTWLKNEFYKLGNETWKGVFIYQGKLLDVCQNLESKLKELLKNFSEIACSEDCIVVEGPILDCWTCLRMTNRCFKGEYCGDEDPRKAENRE

SEQ ID NO: 1492 - protein, 1034 aa, synthetic construct
  REGION 1..1034: note = JAG1 (P78504) ECD
QFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTD

SEQ ID NO: 1493 - protein, 1054 aa, synthetic construct
  REGION 1..1054: note = JAG2 (Q9Y219) ECD
MGYFELQLSALRNVNGELLSGACCDGDGRTTRAGGCGHDECDTYVRVCLKEYQAKVTPTGPCSYGHGATPVLGGNSFYLPPAGAAGDRARARARAGGDQDPGLVVIPFQFAWPRSFTLIVEAWDWDNDTTPNEELLIERVSHAGMINPEDRWKSLHFSGHVAHLELQIRVRCDENYYSATCNKFCRPRNDFFGHYTCDQYGNKACMDGWMGKECKEAVCKQGCNLLHGGCTVPGECRCSYGWQGRFCDECVPYPGCVHGSCVEPWQCNCETNWGGLLCDKDLNYCGSHHPCTNGGTCINAEPDQYRCTCPDGYSGRNCEKAEHACTSNPCANGGSCHEVPSGFECHCPSGWSGPTCALDIDECASNPCAAGGTCVDQVDGFECICPEQWVGATCQLDANECEGKPCLNAFSCKNLIGGYYCDCIPGWKGINCHINVNDCRGQCQHGGTCKDLVNGYQCVCPRGFGGRHCELERDECASSPCHSGGLCEDLADGFHCHCPQGFSGPLCEVDVDLCEPSPCRNGARCYNLEGDYYCACPDDFGGKNCSVPREPCPGGACRVIDGCGSDAGPGMPGTAASGVCGPHGRCVSQPGGNFSCICDSGFTGTYCHENIDDCLGQPCRNGGTCIDEVDAFRCFCPSGWEGELCDTNPNDCLPDPCHSRGRCYDLVNDFYCACDDGWKGKTCHSREFQCDAYTCSNGGTCYDSGDTFRCACPPGWKGSTCAVAKNSSCLPNPCVNGGTCVGSGASFSCICRDGWEGRTCTHNTNDCNPLPCYNGGICVDGVNWFRCECAPGFAGPDCRINIDECQSSPCAYGATCVDEINGYRCSCPPGRAGPRCQEVIGFGRSCWSRGTPFPHGSSWVEDCNSCRCLDGRRDCSKVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSST

SEQ ID NO: 1494 - protein, 210 aa, synthetic construct
  REGION 1..210: note = JAM2 (P57087) ECD
FSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNIS

SEQ ID NO: 1495 - protein, 210 aa, synthetic construct
  REGION 1..210: note = JAM3 (Q9BX67) ECD
VNLKSSNRTPVVQEFESVELSCIITDSQTSDPRIEWKKIQDEQTTYVFFDNKIQGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLN

SEQ ID NO: 1496 - protein, 147 aa, synthetic construct
  REGION 1..147: note = KCT2 (Q8NC54) ECD
RTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDDTLEENRGYMEIEQSVKSFKMPSSNIEEED

SEQ ID NO: 1497 - protein, 745 aa, synthetic construct
  REGION 1..745: note = KDR (P35968) ECD
ASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLE

SEQ ID NO: 1498 - protein, 81 aa, synthetic construct
  REGION 1..81: note = KIAA0247 (Q92537) ECD
SVCPLPPEPENGGYICHPRPCRDPLTAGSVIEYLCAEGYMLKGDYKYLTCKNGEWKPAMEISCRLNEDKDTHTSLGVPTLS

SEQ ID NO: 1499 - protein, 935 aa, synthetic construct
  REGION 1..935: note = KIAA0319 (Q5VV43) ECD
ARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWS

SEQ ID NO: 1500 - protein, 829 aa, synthetic construct
  REGION 1..829: note = KIAA0922 (A2VDJ0) ECD
QAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEES

SEQ ID NO: 1501 - protein, 869 aa, synthetic construct
  REGION 1..869: note = KIAA1324 (Q6UXG2) ECD
TGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITGVAYTSECFPCKPGTYADKQGSSFCKLCPANSYSNKGETSCHQCDPDKYSEKGSSSCNVRPACTDKDYFYTHTACDANGETQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLK

SEQ ID NO: 1502 - protein, 882 aa, synthetic construct
  REGION 1..882: note = KIAA1324L (A8MWY0) ECD
GDLPSSSSRPLPPCQEKDYHFEYTECDSSGSRWRVAIPNSAVDCSGLPDPVRGKECTFSCASGEYLEMKNQVCSKCGEGTYSLGSGIKFDEWDELPAGFSNIATFMDTVVGPSDSRPDGCNNSSWIPRGNYIESNRDDCTVSLIYAVHLKKSGYVFFEYQYVDNNIFFEFFIQNDQCQEMDTTTDKWVKLTDNGEWGSHSVMLKSGTNILYWRTTGILMGSKAVKPVLVKNITIEGVAYTSECFPCKPGTFSNKPGSFNCQVCPRNTYSEKGAKECIRCKDDSQFSEEGSSECTERPPCTTKDYFQIHTPCDEEGKTQIMYKWIEPKICREDLTDAIRLPPSGEKKDCPPCNPGFYNNGSSSCHPCPPGTFSDGTKECRPCPAGTEPALGFEYKWWNVLPGNMKTSCFNVGNSKCDGMNGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDNRRFINDMVKIYSITATNAVDGVASSCRACALGSEQSGSSCVPCPPGHYIEKETNQCKECPPDTYLSIHQVYGKEACIPCGPGSKNNQDHSVCYSDCFFYHEKENQSLHYDFSNLSSVGSLMNGPSFTSKGTKYFHFFNISLCGHEGKKMALCTNNITDFTVKEIVAGSDDYTNLVGAFVCQSTIIPSESKGFRAALSSQSIILADTFIGVTVETTLKNINIKEDMFPVPTSQIPDVHFFYKSSTATTSCINGRSTAVKMRCNPTKSGAGVISVPSKCPAGTCDGCTFYFLWESAEACPLCTEHDFHEIEGACKRGFQETLYVWNEPKWCIKGISLPEKKLATCETVDFWLK

SEQ ID NO: 1503 - protein, 72 aa, synthetic construct
  REGION 1..72: note = KIAA1644 (Q3SXP7) ECD
AHFRVCEPYTDHKGRYHFGFHCPRLSDNKTFILCCHHNNTVFKYCCNETEFQAVMQANLTASSEGYMHNNYT

SEQ ID NO: 1504 - protein, 224 aa, synthetic construct
  REGION 1..224: note = KIR2DL1 (P43626) ECD
HEGVHRKPSLLAHPGPLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQPGPTVLAGENVTLSCSSRSSYDMYHLSREGEAHERRLPAGPKVNGTFQADFPLGPATHGGTYRCFGSFHDSPYEWSKSSDPLLVSVTGNPSNSWPSPTEPSSKTGNPRHLH

SEQ ID NO: 1505 - protein, 224 aa, synthetic construct
  REGION 1..224: note = KIR2DL2 (P43627) ECD
HEGVHRKPSLLAHPGRLVKSEETVILQCWSDVRFEHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHECRFSAGPKVNGTFQADFPLGPATHGGTYRCFGSFRDSPYEWSNSSDPLLVSVIGNPSNSWPSPTEPSSKTGNPRHLH

SEQ ID NO: 1506 - protein, 224 aa, synthetic construct
  REGION 1..224: note = KIR2DL3 (P43628) ECD
HEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSETGNPRHLH

SEQ ID NO: 1507 - protein, 221 aa, synthetic construct
  REGION 1..221: note = KIR2DL4 (Q99706) ECD
WAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLH

SEQ ID NO: 1508 - protein, 217 aa, synthetic construct
  REGION 1..217: note = KIR2DL5A (Q8N109) ECD
HEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVNGTFQADFPLGPATHGGTYTCFGSLHDSPYEWSDPSDPLLVSVTGNSSSSSSSPTEPSSKTGIRRH

SEQ ID NO: 1509 - protein, 217 aa, synthetic construct
  REGION 1..217: note = KIR2DL5B (Q8NHK3) ECD
HEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVDGTFQADFPLGPATHGGTYTCFSSLHDSPYEWSDPSDPLLVSVTGNSSSSSSSPTEPSSKTGIRRH

SEQ ID NO: 1510 - protein, 224 aa, synthetic construct
  REGION 1..224: note = KIR2DS1 (Q14954) ECD
HEGVHRKPSLLAHPGRLVKSEETVILQCWSDVMFEHFLLHREGMFNDTLRLIGEHHDGVSKANFSISRMKQDLAGTYRCYGSVTHSPYQLSAPSDPLDIVIIGLYEKPSLSAQPGPTVLAGENVTLSCSSRSSYDMYHLSREGEAHERRLPAGTKVNGTFQANFPLGPATHGGTYRCFGSFRDSPYEWSKSSDPLLVSVTGNPSNSWPSPTEPSSETGNPRHLH

SEQ ID NO: 1511 - protein, 224 aa, synthetic construct
  REGION 1..224: note = KIR2DS2 (P43631) ECD
HEGVHRKPSLLAHPGPLVKSEETVILQCWSDVRFEHFLLHREGKYKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLH

SEQ ID NO: 1512 - protein, 224 aa, synthetic construct
  REGION 1..224: note = KIR2DS3 (Q14952) ECD
HEGFRRKPSLLAHPGRLVKSEETVILQCWSDVMFEHFLLHREGTFNDTLRLIGEHIDGVSKANFSIGRMRQDLAGTYRCYGSVPHSPYQFSAPSDPLDIVITGLYEKPSLSAQPGPTVLAGESVTLSCSSWSSYDMYHLSTEGEAHERRFSAGPKVNGTFQADFPLGPATQGGTYRCFGSFHDSPYEWSKSSDPLLVSVTGNPSNSWPSPTEPSSKTGNPRHLH

SEQ ID NO: 1513 - protein, 224 aa, synthetic construct
  REGION 1..224: note = KIR2DS4 (P43632) ECD
QEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGLYEKPSLSAQPGPTVQAGENVTLSCSSRSSYDMYHLSREGEAHERRLPAVRSINGTFQADFPLGPATHGGTYRCFGSFRDAPYEWSNSSDPLLVSVTGNPSNSWPSPTEPSSKTGNPRHLH

SEQ ID NO: 1514 - protein, 224 aa, synthetic construct
  REGION 1..224: note = KIR2DS5 (Q14953) ECD
HEGFRRKPSLLAHPGPLVKSEETVILQCWSDVMFEHFLLHREGTFNHTLRLIGEHIDGVSKGNFSIGRMTQDLAGTYRCYGSVTHSPYQLSAPSDPLDIVITGLYEKPSLSAQPGPTVLAGESVTLSCSSRSSYDMYHLSREGEAHERRLPAGPKVNRTFQADFPLDPATHGGTYRCFGSFRDSPYEWSKSSDPLLVSVTGNSSNSWPSPTEPSSETGNPRHLH

SEQ ID NO: 1515 - protein, 319 aa, synthetic construct
  REGION 1..319: note = KIR3DL1 (P43629) ECD
HMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLH

SEQ ID NO: 1516 - protein, 319 aa, synthetic construct
  REGION 1..319: note = KIR3DL2 (P43630) ECD
LMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLH

SEQ ID NO: 1517 - protein, 297 aa, synthetic construct
  REGION 1..297: note = KIR3DL3 (Q8N743) ECD
QDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRHL

SEQ ID NO: 1518 - protein, 319 aa, synthetic construct
  REGION 1..319: note = KIR3DS1 (Q14943) ECD
HMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHREWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLH

SEQ ID NO: 1519 - protein, 483 aa, synthetic construct
  REGION 1..483: note = KIRREL (Q96J84) ECD
QGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIA

SEQ ID NO: 1520 - protein, 490 aa, synthetic construct
  REGION 1..490: note = KIRREL2 (Q6UWL6) ECD
GPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVR

SEQ ID NO: 1521 - protein, 514 aa, synthetic construct
  REGION 1..514: note = KIRREL3 (Q8IZU9) ECD
LQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQGSEMKSGAGLEAESVPMA

SEQ ID NO: 1522 - protein, 499 aa, synthetic construct
  REGION 1..499: note = KIT (P10721) ECD
QPSVSPGEPSPPSIHPGKSDLIVRVGDEIRLLCTDPGFVKWTFEILDETNENKQNEWITEKAEATNTGKYTCTNKHGLSNSIYVFVRDPAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEFTVTCTIKDVSSSVYSTWKRENSQTKLQEKYNSWHHGDFNYERQATLTISSARVNDSGVFMCYANNTFGSANVTTTLEVVDKGFINIFPMINTTVFVNDGENVDLIVEYEAFPKPEHQQWIYMNRTFTDKWEDYPKSENESNIRYVSELHLTRLKGTEGGTYTFLVSNSDVNAAIAFNVYVNTKPEILTYDRLVNGMLQCVAAGFPEPTIDWYFCPGTEQRCSASVLPVDVQTLNSSGPPFGKLVVQSSIDSSAFKHNGTVECKAYNDVGKTSAYFNFAFKGNNKEQIHPHTLFTP

SEQ ID NO: 1523 - protein, 189 aa, synthetic construct
  REGION 1..189: note = KITLG (P21583) ECD
EGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLH

SEQ ID NO: 1524 - protein, 948 aa, synthetic construct
  REGION 1..948: note = KL (Q9UEF7) ECD
EPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKS

SEQ ID NO: 1525 - protein, 372 aa, synthetic construct
  REGION 1..372: note = KREMEN1 (Q96MU8) ECD
RPAPSPGLGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEGWT

SEQ ID NO: 1526 - protein, 339 aa, synthetic construct
  REGION 1..339: note = KREMEN2 (Q8NCW0) ECD
GSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAA

SEQ ID NO: 1527 - protein, 1101 aa, synthetic construct
  REGION 1..1101: note = L1CAM (P32004) ECD
IQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATE

SEQ ID NO: 1528 - protein, 428 aa, synthetic construct
  REGION 1..428: note = LAG3 (P18627) ECD
LQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 1529 - protein, 144 aa, synthetic construct
  REGION 1..144: note = LAIR1 (Q6GTX8) ECD
QEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLY

SEQ ID NO: 1530 - protein, 354 aa, synthetic construct
  REGION 1..354: note = LAMP1 (P11279) ECD
AMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSM

SEQ ID NO: 1531 - protein, 347 aa, synthetic construct
  REGION 1..347: note = LAMP2 (P13473) ECD
LELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQDCSADDDNF

SEQ ID NO: 1532 - protein, 354 aa, synthetic construct
  REGION 1..354: note = LAMP3 (Q9UQV4) ECD
KAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVFSPRRYFNIDPNATQASGNCGTRKSNLLLNFQGGFVNLTFTKDEESYYISEVGAYLTVSDPETIYQGIKHAVVMFQTAVGHSFKCVSEQSLQLSAHLQVKTTDVQLQAFDFEDDHFGNVDECSSDYT

SEQ ID NO: 1533 - protein, 206 aa, synthetic construct
  REGION 1..206: note = LAMP5 (Q9UJQ1) ECD
EQEVENLSGLSTNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEE

SEQ ID NO: 1534 - protein, 214 aa, synthetic construct
  REGION 1..214: note = LAYN (Q6UX15) ECD
ATGRLLSASDLDLRGGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAY

SEQ ID NO: 1535 - protein, 1863 aa, synthetic construct
  REGION 1..1863: note = LCT (P09848) ECD
SDWESDRNFISTAGPLTNDLLHNLSGLLGDQSSNFVAGDKDMYVCHQPLPTFLPEYFSSLHASQITHYKVFLSWAQLLPAGSTQNPDEKTVQCYRRLLKALKTARLQPMVILHHQTLPASTLRRTEAFADLFADYATFAFHSFGDLVGIWFTFSDLEEVIKELPHQESRASQLQTLSDAHRKAYEIYHESYAFQGGKLSVVLRAEDIPELLLEPPISALAQDTVDFLSLDLSYECQNEASLRQKLSKLQTIEPKVKVFIFNLKLPDCPSTMKNPASLLFSLFEAINKDQVLTIGFDINEFLSCSSSSKKSMSCSLTGSLALQPDQQQDHETTDSSPASAYQRIWEAFANQSRAERDAFLQDTFPEGFLWGASTGAFNVEGGWAEGGRGVSIWDPRRPLNTTEGQATLEVASDSYHKVASDVALLCGLRAQVYKFSISWSRIFPMGHGSSPSLPGVAYYNKLIDRLQDAGIEPMATLFHWDLPQALQDHGGWQNESVVDAFLDYAAFCFSTFGDRVKLWVTFHEPWVMSYAGYGTGQHPPGISDPGVASFKVAHLVLKAHARTWHHYNSHHRPQQQGHVGIVLNSDWAEPLSPERPEDLRASERFLHFMLGWFAHPVFVDGDYPATLRTQIQQMNRQCSHPVAQLPEFTEAEKQLLKGSADFLGLSHYTSRLISNAPQNTCIPSYDTIGGFSQHVNHVWPQTSSSWIRVVPWGIRRLLQFVSLEYTRGKVPIYLAGNGMPIGESENLFDDSLRVDYFNQYINEVLKAIKEDSVDVRSYIARSLIDGFEGPSGYSQRFGLHHVNFSDSSKSRTPRKSAYFFTSIIEKNGFLTKGAKRLLPPNTVNLPSKVRAFTFPSEVPSKAKVVWEKFSSQPKFERDLFYHGTFRDDFLWGVSSSAYQIEGAWDADGKGPSIWDNFTHTPGSNVKDNATGDIACDSYHQLDADLNMLRALKVKAYRFSISWSRIFPTGRNSSINSHGVDYYNRLINGLVASNIFPMVTLFHWDLPQALQDIGGWENPALIDLFDSYADFCFQTFGDRVKFWMTFNEPMYLAWLGYGSGEFPPGVKDPGWAPYRIAHAVIKAHARVYHTYDEKYRQEQKGVISLSLSTHWAEPKSPGVPRDVEAADRMLQFSLGWFAHPIFRNGDYPDTMKWKVGNRSELQHLATSRLPSFTEEEKRFIRATADVFCLNTYYSRIVQHKTPRLNPPSYEDDQEMAEEEDPSWPSTAMNRAAPWGTRRLLNWIKEEYGDIPIYITENGVGLTNPNTEDTDRIFYHKTYINEALKAYRLDGIDLRGYVAWSLMDNFEWLNGYTVKFGLYHVDFNNTNRPRTARASARYYTEVITNNGMPLAREDEFLYGRFPEGFIWSAASAAYQIEGAWRADGKGLSIWDTFSHTPLRVENDAIGDVACDSYHKIAEDLVTLQNLGVSHYRFSISWSRILPDGTTRYINEAGLNYYVRLIDTLLAASIQPQVTIYHWDLPQTLQDVGGWENETIVQRFKEYADVLFQRLGDKVKFWITLNEPFVIAYQGYGYGTAAPGVSNRPGTAPYIVGHNLIKAHAEAWHLYNDVYRASQGGVISITISSDWAEPRDPSNQEDVEAARRYVQFMGGWFAHPIFKNGDYNEVMKTRIRDRSLAAGLNKSRLPEFTESEKRRINGTYDFFGFNHYTTVLAYNLNYATAISSFDADRGVASIADRSWPDSGSFWLKMTPFGFRRILNWLKEEYNDPPIYVTENGVSQREETDLNDTARIYYLRTYINEALKAVQDKVDLRGYTVWSAMDNFEWATGFSERFGLHFVNYSDPSLPRIPKASAKFYASVVRCNGFPDPATGPHACLHQPDAGPTISPVRQEEVQFLGLMLGTTEAQT

SEQ ID NO: 1536 - protein, 767 aa, synthetic construct
  REGION 1..767: note = LDLR (P01130) ECD
AVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVR

SEQ ID NO: 1537 - protein, 156 aa, synthetic construct
  REGION 1..156: note = LDLRAD3 (Q86YD5) ECD
QLLPGNNFTNECNIPGNFMCSNGRCIPGAWQCDGLPDCFDKSDEKECPKAKSKCGPTFFPCASGIHCIIGRFRCNGFEDCPDGSDEENCTANPLLCSTARYHCKNGLCIDKSFICDGQNNCQDNSDEESCESSQEPGSGQVFVTSENQLVYYPSIT

SEQ ID NO: 1538 - protein, 818 aa, synthetic construct
  REGION 1..818: note = LEPR (P48357) ECD
FNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSD

SEQ ID NO: 1539 - protein, 789 aa, synthetic construct
  REGION 1..789: note = LIFR (P42702) ECD
QKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENS

SEQ ID NO: 1540 - protein, 445 aa, synthetic construct
  REGION 1..445: note = LILRA1 (O75019) ECD
PRTHVQAGTLPKPTLWAEPGSVITQGSPVTLWCQGILETQEYRLYREKKTAPWITRIPQEIVKKGQFPIPSITWEHTGRYRCFYGSHTAGWSEPSDPLELVVTGAYIKPTLSALPSPVVTSGGNVTLHCVSQVAFGSFILCKEGEDEHPQCLNSQPRTHGWSRAIFSVGPVSPSRRWSYRCYAYDSNSPHVWSLPSDLLELLVLGVSKKPSLSVQPGPIVAPGESLTLQCVSDVSYDRFVLYKEGERDFLQLPGPQPQAGLSQANFTLGPVSRSYGGQYRCSGAYNLSSEWSAPSDPLDILIAGQFRGRPFISVHPGPTVASGENVTLLCQSWGPFHTFLLTKAGAADAPLRLRSIHEYPKYQAEFPMSPVTSAHSGTYRCYGSLSSNPYLLSHPSDSLELMVSGAAETLSPPQNKSDSKAGAANTLSPSQNKTASHPQDYTVEN

SEQ ID NO: 1541 - protein, 426 aa, synthetic construct
  REGION 1..426: note = LILRA2 (Q8N149) ECD
GHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSEAAETLSPSQNKTDSTTTSLGQHPQDYTVEN

SEQ ID NO: 1542 - protein, 423 aa, synthetic construct
  REGION 1..423: note = LILRA4 (P59901) ECD
ENLPKPILWAEPGPVITWHNPVTIWCQGTLEAQGYRLDKEGNSMSRHILKTLESENKVKLSIPSMMWEHAGRYHCYYQSPAGWSEPSDPLELVVTAYSRPTLSALPSPVVTSGVNVTLRCASRLGLGRFTLIEEGDHRLSWTLNSHQHNHGKFQALFPMGPLTFSNRGTFRCYGYENNTPYVWSEPSDPLQLLVSGVSRKPSLLTLQGPVVTPGENLTLQCGSDVGYIRYTLYKEGADGLPQRPGRQPQAGLSQANFTLSPVSRSYGGQYRCYGAHNVSSEWSAPSDPLDILIAGQISDRPSLSVQPGPTVTSGEKVTLLCQSWDPMFTFLLTKEGAAHPPLRLRSMYGAHKYQAEFPMSPVTSAHAGTYRCYGSRSSNPYLLSHPSEPLELVVSGATETLNPAQKKSDSKTAPHLQDYTVEN

SEQ ID NO: 1543 - protein, 227 aa, synthetic construct
  REGION 1..227: note = LILRA5 (A6NI73) ECD
GNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGAADNLSPSQNKSDSGTASHLQDYAVENLIR

SEQ ID NO: 1544 - protein, 424 aa, synthetic construct
  REGION 1..424: note = LILRA6 (Q6PI73) ECD
GPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPRVWSHPSDPLEILPSGVSRKPSLLTLQGPVLAPGQSLTLQCGSDVGYDRFVLYKEGERDFLQRPGQQPQAGLSQANFTLGPVSPSHGGQYRCYGAHNLSSEWSAPSDPLNILMAGQIYDTVSLSAQPGPTVASGENVTLLCQSRGYFDTFLLTKEGAAHPPLRLRSMYGAHKYQAEFPMSPVTSAHAGTYRCYGSYSSNPHLLSFPSEPLELMVSGHSGGSSLPPTGPPSTPASHAKDYTVEN

SEQ ID NO: 1545 - protein, 438 aa, synthetic construct
  REGION 1..438: note = LILRB1 (Q8NHL6) ECD
GHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGV

SEQ ID NO: 1546 - protein, 440 aa, synthetic construct
  REGION 1..440: note = LILRB2 (Q8N423) ECD
QTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGV

SEQ ID NO: 1547 - protein, 420 aa, synthetic construct
  REGION 1..420: note = LILRB3 (O75022) ECD
GPFPKPTLWAEPGSVISWGSPVTIWCQGSQEAQEYRLHKEGSPEPLDRNNPLEPKNKARFSIPSMTEHHAGRYRCHYYSSAGWSEPSDPLEMVMTGAYSKPTLSALPSPVVASGGNMTLRCGSQKGYHHFVLMKEGEHQLPRTLDSQQLHSRGFQALFPVGPVTPSHRWRFTCYYYYTNTPWVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGLGRYLE

SEQ ID NO: 1548 - protein, 435 aa, synthetic construct
  REGION 1..435: note = LILRB5 (O75023) ECD
GTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPGPEDQPLTPTGLDPQSGLGRHLG

SEQ ID NO: 1549 - protein, 520 aa, synthetic construct
  REGION 1..520: note = LINGO1 (Q96FE5) ECD
CPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIAT

SEQ ID NO: 1550 - protein, 518 aa, synthetic construct
  REGION 1..518: note = LINGO2 (Q7L985) ECD
CPARCECSAQNKSVSCHRRRLIAIPEGIPIETKILDLSKNRLKSVNPEEFISYPLLEEIDLSDNIIANVEPGAFNNLFNLRSLRLKGNRLKLVPLGVFTGLSNLTKLDISENKIVILLDYMFQDLHNLKSLEVGDNDLVYISHRAFSGLLSLEQLTLEKCNLTAVPTEALSHLRSLISLHLKHLNINNMPVYAFKRLFHLKHLEIDYWPLLDMMPANSLYGLNLTSLSVTNTNLSTVPFLAFKHLVYLTHLNLSYNPISTIEAGMFSDLIRLQELHIVGAQLRTIEPHSFQGLRFLRVLNVSQNLLETLEENVFSSPRALEVLSINNNPLACDCRLLWILQRQPTLQFGGQQPMCAGPDTIRERSFKDFHSTALSFYFTCKKPKIREKKLQHLLVDEGQTVQLECSADGDPQPVISWVTPRRRFITTKSNGRATVLGDGTLEIRFAQDQDSGMYVCIASNAAGNDTFTASLTVKGFASDRFLYANRTPMYMTDSNDTISNGTNANTFSLDLKTILVST

SEQ ID NO: 1551 - protein, 507 aa, synthetic construct
  REGION 1..507: note = LINGO3 (P0C6S8) ECD
CPARCECTVQTRAVACTRRRLTAVPDGIPAETRLLELSRNRIRCLNPGDLAALPALEELDLSENAIAHVEPGAFANLPRLRVLRLRGNQLKLIPPGVFTRLDNLTLLDLSENKLVILLDYTFQDLHSLRRLEVGDNDLVFVSRRAFAGLLALEELTLERCNLTALSGESLGHLRSLGALRLRHLAIASLEDQNFRRLPGLLHLEIDNWPLLEEVAAGSLRGLNLTSLSVTHTNITAVPAAALRHQAHLTCLNLSHNPISTVPRGSFRDLVRLRELHLAGALLAVVEPQAFLGLRQIRLLNLSNNLLSTLEESTFHSVNTLETLRVDGNPLACDCRLLWIVQRRKTLNFDGRLPACATPAEVRGDALRNLPDSVLFEYFVCRKPKIRERRLQRVTATAGEDVRFLCRAEGEPAPTVAWVTPQHRPVTATSAGRARVLPGGTLEIQDARPQDSGTYTCVASNAGGNDTYFATLTVRPEPAANRTPGEAHNETLAALRAPLDLTTILVST

SEQ ID NO: 1552 - protein, 505 aa, synthetic construct
  REGION 1..505: note = LINGO4 (Q6UY18) ECD
GSCPAVCDCTSQPQAVLCGHRQLEAVPGGLPLDTELLDLSGNRLWGLQQGMLSRLSLLQELDLSYNQLSTLEPGAFHGLQSLLTLRLQGNRLRIMGPGVFSGLSALTLLDLRLNQIVLFLDGAFGELGSLQKLEVGDNHLVFVAPGAFAGLAKLSTLTLERCNLSTVPGLALARLPALVALRLRELDIGRLPAGALRGLGQLKELEIHLWPSLEALDPGSLVGLNLSSLAITRCNLSSVPFQALYHLSFLRVLDLSQNPISAIPARRLSPLVRLQELRLSGACLTSIAAHAFHGLTAFHLLDVADNALQTLEETAFPSPDKLVTLRLSGNPLTCDCRLLWLLRLRRHLDFGMSPPACAGPHHVQGKSLKEFSDILPPGHFTCKPALIRKSGPRWVIAEEGGHAVFSCSGDGDPAPTVSWMRPHGAWLGRAGRVRVLEDGTLEIRSVQLRDRGAYVCVVSNVAGNDSLRTWLEVIQVEPPNGTLSDPNITVPGIPGPFFLDSRGVA

SEQ ID NO: 1553 - protein, 278 aa, synthetic construct
  REGION 1..278: note = LMAN2 (Q12907) ECD
DITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPSVNFLKSPKDNVDDPTGNFRSGPLTGWR

SEQ ID NO: 1554 - protein, 269 aa, synthetic construct
  REGION 1..269: note = LMAN2L (Q9H0V9) ECD
GQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLA

SEQ ID NO: 1555 - protein, 505 aa, synthetic construct
  REGION 1..505: note = LRFN1 (Q9P244) ECD
QPCPGRCICQNVAPTLTMLCAKTGLLFVPPAIDRRVVELRLTDNFIAAVRRRDFANMTSLVHLTLSRNTIGQVAAGAFADLRALRALHLDSNRLAEVRGDQLRGLGNLRHLILGNNQIRRVESAAFDAFLSTVEDLDLSYNNLEALPWEAVGQMVNLNTLTLDHNLIDHIAEGTFVQLHKLVRLDMTSNRLHKLPPDGLFLRSQGTGPKPPTPLTVSFGGNPLHCNCELLWLRRLTREDDLETCATPEHLTDRYFWSIPEEEFLCEPPLITRQAGGRALVVEGQAVSLRCRAVGDPEPVVHWVAPDGRLLGNSSRTRVRGDGTLDVTITTLRDSGTFTCIASNAAGEATAPVEVCVVPLPLMAPPPAAPPPLTEPGSSDIATPGRPGANDSAAERRLVAAELTSNSVLIRWPAQRPVPGIRMYQVQYNSSVDDSLVYRMIPSTSQTFLVNDLAAGRAYDLCVLAVYDDGATALPATRVVGCVQFTTAGDPAPCRPLRAHFLGGTM

SEQ ID NO: 1556 - protein, 514 aa, synthetic construct
  REGION 1..514: note = LRFN2 (Q9ULH4) ECD
CPKYCVCQNLSESLGTLCPSKGLLFVPPDIDRRTVELRLGGNFIIHISRQDFANMTGLVDLTLSRNTISHIQPFSFLDLESLRSLHLDSNRLPSLGEDTLRGLVNLQHLIVNNNQLGGIADEAFEDFLLTLEDLDLSYNNLHGLPWDSVRRMVNLHQLSLDHNLLDHIAEGTFADLQKLARLDLTSNRLQKLPPDPIFARSQASALTATPFAPPLSFSFGGNPLHCNCELLWLRRLERDDDLETCGSPGGLKGRYFWHVREEEFVCEPPLITQHTHKLLVLEGQAATLKCKAIGDPSPLIHWVAPDDRLVGNSSRTAVYDNGTLDIFITTSQDSGAFTCIAANAAGEATAMVEVSIVQLPHLSNSTSRTAPPKSRLSDITGSSKTSRGGGGSGGGEPPKSPPERAVLVSEVTTTSALVKWSVSKSAPRVKMYQLQYNCSDDEVLIYRMIPASNKAFVVNNLVSGTGYDLCVLAMWDDTATTLTATNIVGCAQFFTKADYPQCQSMHSQILGGTM

SEQ ID NO: 1557 - protein, 523 aa, synthetic construct
  REGION 1..523: note = LRFN3 (Q9BTN0) ECD
SSPPQSATPSPCPRRCRCQTQSLPLSVLCPGAGLLFVPPSLDRRAAELRLADNFIASVRRRDLANMTGLLHLSLSRNTIRHVAAGAFADLRALRALHLDGNRLTSLGEGQLRGLVNLRHLILSNNQLAALAAGALDDCAETLEDLDLSYNNLEQLPWEALGRLGNVNTLGLDHNLLASVPAGAFSRLHKLARLDMTSNRLTTIPPDPLFSRLPLLARPRGSPASALVLAFGGNPLHCNCELVWLRRLAREDDLEACASPPALGGRYFWAVGEEEFVCEPPVVTHRSPPLAVPAGRPAALRCRAVGDPEPRVRWVSPQGRLLGNSSRARAFPNGTLELLVTEPGDGGIFTCIAANAAGEATAAVELTVGPPPPPQLANSTSCDPPRDGDPDALTPPSAASASAKVADTGPPTDRGVQVTEHGATAALVQWPDQRPIPGIRMYQIQYNSSADDILVYRMIPAESRSFLLTDLASGRTYDLCVLAVYEDSATGLTATRPVGCARFSTEPALRPCGAPHAPFLGGTM

SEQ ID NO: 1558 - protein, 502 aa, synthetic construct
  REGION 1..502: note = LRFN4 (Q6PJG9) ECD
CPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGVTGAGDAGGYTCIATNPAGEATARVELRVLALPHGGNSSAEGGRPGPSDIAASARTAAEGEGTLESEPAVQVTEVTATSGLVSWGPGRPADPVWMFQIQYNSSEDETLIYRIVPASSHHFLLKHLVPGADYDLCLLALSPAAGPSDLTATRLLGCAHFSTLPASPLCHALQAHVLGGTL

SEQ ID NO: 1559 - protein, 512 aa, synthetic construct
  REGION 1..512: note = LRFN5 (Q96NI6) ECD
QICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRMIPPTSKTFLVNNLAAGTMYDLCVLAIYDDGITSLTATRVVGCIQFTTEQDYVRCHFMQSQFLGGTM

SEQ ID NO: 1560 - protein, 760 aa, synthetic construct
  REGION 1..760: note = LRIG1 (Q96JA1) ECD
AGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVG

SEQ ID NO: 1561 - protein, 767 aa, synthetic construct
  REGION 1..767: note = LRIG2 (O94898) ECD
GLCPAPCSCRIPLLDCSRRKLPAPSWRALSGLLPPDTAILDFSHNRLSNWNISLESQTLQEVKMNYNELTEIPYFGEPTSNITLLSLVHNIIPEINAQALQFYPALESLDLSSNIISEIKTSSFPRMQLKYLNLSNNRITTLEAGCFDNLSSSLLVVKLNRNRMSMIPPKIFKLPHLQFLELKRNRIKIVEGLTFQGLDSLRSLKMQRNGISKLKDGAFFGLNNMEELELEHNNLTRVNKGWLYGLRMLQQLYVSQNAIERISPDAWEFCQRLSELDLSYNQLTRLDESAFVGLSLLERLNLGDNRVTHIADGVFRFLSNLQTLDLRNNEISWAIEDASEAFAGLTSLTKLILQGNQIKSITKKAFIGLESLEHLDLNNNAIMSIQENAFSQTHLKELILNTSSLLCDCHLKWLLQWLVDNNFQHSVNVSCAHPEWLAGQSILNVDLKDFVCDDFLKPQIRTHPETIIALRGMNVTLTCTAVSSSDSPMSTVWRKDSEILYDVDTENFVRYWQQAGEALEYTSILHLFNVNFTDEGKYQCIVTNHFGSNYSQKAKLTVNEMPSFLKTPMDLTIRTGAMARLECAAEGHPAPQISWQKDGGTDFPAARERRMHVMPEDDVFFIANVKIEDMGIYSCMAQNTAGGLSANASLTVLETPSFIRPLEDKTVTRGETAVLQCIAGGSPAPRLNWTKDDGPLLVTERHFFAAANQLLIIVDAGLEDAGKYTCIMSNTLGTERGHIYLNVISSPNCDSSQSSIGHEDDGWTTVG

SEQ ID NO: 1562 - protein, 785 aa, synthetic construct
  REGION 1..785: note = LRIG3 (Q6UXM1) ECD
GRSDSGGRGELGQPSGVAAERPCPTTCRCLGDLLDCSRKRLARLPEPLPSWVARLDLSHNRLSFIKASSMSHLQSLREVKLNNNELETIPNLGPVSANITLLSLAGNRIVEILPEHLKEFQSLETLDLSSNNISELQTAFPALQLKYLYLNSNRVTSMEPGYFDNLANTLLVLKLNRNRISAIPPKMFKLPQLQHLELNRNKIKNVDGLTFQGLGALKSLKMQRNGVTKLMDGAFWGLSNMEILQLDHNNLTEITKGWLYGLLMLQELHLSQNAINRISPDAWEFCQKLSELDLTFNHLSRLDDSSFLGLSLLNTLHIGNNRVSYIADCAFRGLSSLKTLDLKNNEISWTIEDMNGAFSGLDKLRRLILQGNRIRSITKKAFTGLDALEHLDLSDNAIMSLQGNAFSQMKKLQQLHLNTSSLLCDCQLKWLPQWVAENNFQSFVNASCAHPQLLKGRSIFAVSPDGFVCDDFPKPQITVQPETQSAIKGSNLSFICSAASSSDSPMTFAWKKDNELLHDAEMENYAHLRAQGGEVMEYTTILRLREVEFASEGKYQCVISNHFGSSYSVKAKLTVNMLPSFTKTPMDLTIRAGAMARLECAAVGHPAPQIAWQKDGGTDFPAARERRMHVMPEDDVFFIVDVKIEDIGVYSCTAQNSAGSISANATLTVLETPSFLRPLLDRTVTKGETAVLQCIAGGSPPPKLNWTKDDSPLVVTERHFFAAGNQLLIIVDSDVSDAGKYTCEMSNTLGTERGNVRLSVIPTPTCDSPQMTAPSLDDDGWATVG

SEQ ID NO: 1563 - protein, 505 aa, synthetic construct
  REGION 1..505: note = LRIT1 (Q9P2V4) ECD
FCPSQCSCSLHIMGDGSKARTVVCNDPDMTLPPASIPPDTSRLRLERTAIRRVPGEAFRPLGRLEQLWLPYNALSELNALMLRGLRRLRELRLPGNRLAAFPWAALRDAPKLRLLDLQANRLSAVPAEAARFLENLTFLDLSSNQLMRLPQELIVSWAHLETGIFPPGHHPRRVLGLQDNPWACDCRLYDLVHLLDGWAPNLAFIETELRCASPRSLAGVAFSQLELRKCQGPELHPGVASIRSLLGGTALLRCGATGVPGPEMSWRRANGRPLNGTVHQEVSSDGTSWTLLGLPAVSHLDSGDYICQAKNFLGASETVISLIVTEPPTSTEHSGSPGALWARTGGGGEAAAYNNKLVARHVPQIPKPAVLATGPSVPSTKEELTLEHFQMDALGELSDGRAGPSEARMVRSVKVVGDTYHSVSLVWKAPQAKNTTAFSVLYAVFGQHSMRRVIVQPGKTRVTITGLLPKTKYVACVCVQGLVPRKEQCVIFSTNEVVDAENTQQ

SEQ ID NO: 1564 - protein, 446 aa, synthetic construct
  REGION 1..446: note = LRIT2 (A6NDA9) ECD
AQPFCLPGCTCSEESFGRTLQCTSVSLGKIPGNLSEEFKQVRIENSPLFEMPQGSFINMSTLEYLWLNFNNISVIHLGALEHLPELRELRLEGNKLCSVPWTAFRATPLLRVLDLKRNKIDALPELALQFLVSLTYLDLSSNRLTVVSKSVFLNWPAYQKCRQPDCGAEILSSLVVALHDNPWVCDCRLRGLVQFVKSITLPVILVNSYLICQGPLSKAGQLFHETELSACMKPQISTPSANITIRAGQNVTLRCLAQASPSPSIAWTYPLSMWREFDVLTSSTGEDTALSELAIPAAHLVDSGNYTCMASNSIGKSNLVISLHVQPAQALHAPDSLSIPSEGNAYIDLRVVKQTVHGILLEWLAVADTSKEEWFTLYIASDEAFRKEVVHIGPGINTYAVDDLLPGTKYEACLSLEGQPPHQGQCVAFVTGRDAGGLEAREHLLH

SEQ ID NO: 1565 - protein, 563 aa, synthetic construct
  REGION 1..563: note = LRIT3 (Q3SXY7) ECD
LCPSQCTCDYHGRNDGSGSRLVLCNDMDMNELPTNLPVDTVKLRIEKTVIRRISAEAFYYLVELQYLWVTYNSVASIDPSSFYNLKQLHELRLDGNSLAAFPWASLLDMPLLRTLDLHNNKITSVPNEALRYLKNLAYLDLSSNRLTTLPPDFLESWTHLVSTPSGVLDLSPSRIILGLQDNPWFCDCHISKMIELSKVVDPAIVLLDPLMTCSEPERLTGILFQRAELEHCLKPSVMTSATKIMSALGSNVLLRCDATGFPTPQITWTRSDSSPVNYTVIQESPEEGVRWSIMSLTGISSKDAGDYKCKAKNLAGMSEAVVTVTVLGITTTPIPPDTSERTGDHPEWDVQPGSGRSTSVSSASSYLWSSSFSPTSSFSASTLSPPSTASFSLSPFSSSTVSSTTTLSTSISASTTMANKRSFQLHQGGKRNLKVAKNGSKLPPASTSKKEELALLDQTMLTETNAAIENLRVVSETKESVTLTWNMINTTHNSAVTVLYSKYGGKDLLLLNADSSKNQVTIDGLEPGGQYMACVCPKGVPPQKDQCITFSTERVEGDDSQWS

SEQ ID NO: 1566 - protein, 4400 aa, synthetic construct
  REGION 1..4400: note = LRP1 (Q07954) ECD
AIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSQEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPG

SEQ ID NO: 1567 - protein, 424 aa, synthetic construct
  REGION 1..424: note = LRP10 (Q7Z4F1) ECD
HPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRK

SEQ ID NO: 1568 - protein, 413 aa, synthetic construct
  REGION 1..413: note = LRP11 (Q86VZ4) ECD
ALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGGCLHTCSRYHFFCDDGCCIDITLACDGVQQCPDGSDEDFCQNLGLDRKMVTHTAASPALPRTTGPSEDAGGDSLVEKSQKATAPNKPPALSNTEKRNHSAFWGPESQIIPVMPDSSSSGKNRKEESYIFESKGDGGGGEHPAPETG

SEQ ID NO: 1569 - protein, 460 aa, synthetic construct
  REGION 1..460: note = LRP12 (Q9Y561) ECD
EHSENVHISGVSTACGETPEQIRAPSGIITSPGWPSEYPAKINCSWFIRANPGEIITISFQDFDIQGSRRCNLDWLTIETYKNIESYRACGSTIPPPYISSQDHIWIRFHSDDNISRKGFRLAYFSGKSEEPNCACDQFRCGNGKCIPEAWKCNNMDECGDSSDEEICAKEANPPTAAAFQPCAYNQFQCLSRFTKVYTCLPESLKCDGNIDCLDLGDEIDCDVPTCGQWLKYFYGTFNSPNYPDFYPPGSNCTWLIDTGDHRKVILRFTDFKLDGTGYGDYVKIYDGLEENPHKLLRVLTAFDSHAPLTVVSSSGQIRVHFCADKVNAARGFNATYQVDGFCLPWEIPCGGNWGCYTEQQRCDGYWHCPNGRDETNCTMCQKEEFPCSRNGVCYPRSDRCNYQNHCPNGSDEKNCFFCQPGNFHCKNNRCVFESWVCDSQDDCGDGSDEENCPVIVPTR

SEQ ID NO: 1570 - protein, 4420 aa, synthetic construct
  REGION 1..4420: note = LRP1B (Q9NZR2) ECD
ADRDQQLCDPGEFLCHDHVTCVSQSWLCDGDPDCPDDSDESLDTCPEEVEIKCPLNHIACLGTNKCVHLSQLCNGVLDCPDGYDEGVHCQELLSNCQQLNCQYKCTMVRNSTRCYCEDGFEITEDGRSCKDQDECAVYGTCSQTCRNTHGSYTCSCVEGYLMQPDNRSCKAKIEPTDRPPILLIANFETIEVFYLNGSKMATLSSVNGNEIHTLDFIYNEDMICWIESRESSNQLKCIQITKAGGLTDEWTINILQSFHNVQQMAIDWLTRNLYFVDHVGDRIFVCNSNGSVCVTLIDLELHNPKAIAVDPIAGKLFFTDYGNVAKVERCDMDGMNRTRIIDSKTEQPAALALDLVNKLVYWVDLYLDYVGVVDYQGKNRHTVIQGRQVRHLYGITVFEDYLYATNSDNYNIVRINRFNGTDIHSLIKIENAWGIRIYQKRTQPTVRSHACEVDPYGMPGGCSHICLLSSSYKTRTCRCRTGFNLGSDGRSCKRPKNELFLFYGKGRPGIVRGMDLNTKIADEYMIPIENLVNPRALDFHAETNYIYFADTTSFLIGRQKIDGTERETILKDDLDNVEGIAVDWIGNNLYWTNDGHRKTINVARLEKASQSRKTLLEGEMSHPRGIVVDPVNGWMYWTDWEEDEIDDSVGRIEKAWMDGFNRQIFVTSKMLWPNGLTLDFHTNTLYWCDAYYDHIEKVFLNGTHRKIVYSGRELNHPFGLSHHGNYVFWTDYMNGSIFQLDLITSEVTLLRHERPPLFGLQIYDPRKQQGDNMCRVNNGGCSTLCLAIPGGRVCACADNQLLDENGTTCTFNPGEALPHICKAGEFRCKNRHCIQARWKCDGDDDCLDGSDEDSVNCFNHSCPDDQFKCQNNRCIPKRWLCDGANDCGSNEDESNQTCTARTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCSKRDGRNPTILRNKTSGVVHMKVYDKEAQQGSNSCQLNNGGCSQLCLPTSETTRTCMCTVGYYLQKNRMSCQGIESFLMYSVHEGIRGIPLEPSDKMDALMPISGTSFAVGIDFHAENDTIYWTDMGFNKISRAKRDQTWKEDIITNGLGRVEGIAVDWIAGNIYWTDHGFNLIEVARLNGSFRYVIISQGLDQPRSIAVHPEKGLLFWTEWGQMPCIGKARLDGSEKVVLVSMGIAWPNGISIDYEENKLYWCDARTDKIERIDLETGGNREMVLSGSNVDMFSVAVFGAYIYWSDRAHANGSVRRGHKNDATETITMRTGLGVNLKEVKIFNRVREKGTNVCARDNGGCKQLCLYRGNSRRTCACAHGYLAEDGVTCLRHEGYLLYSGRTILKSIHLSDETNLNSPIRPYENPRYFKNVIALAFDYNQRRKGTNRIFYSDAHFGNIQLIKDNWEDRQVIVENVGSVEGLAYHRAWDTLYWTSSTTSSITRHTVDQTRPGAFDREAVITMSEDDHPHVLALDECQNLMFWTNWNEQHPSIMRSTLTGKNAQVVVSTDILTPNGLTIDYRAEKLYFSDGSLGKIERCEYDGSQRHVIVKSGPGTFLSLAVYDNYIFWSDWGRRAILRSNKYTGGDTKILRSDIPHQPMGIIAVANDTNSCELSPCALLNGGCHDLCLLTPNGRVNCSCRGDRILLEDNRCVTKNSSCNAYSEFECGNGECIDYQLTCDGIPHCKDKSDEKLLYCENRSCRRGFKPCYNRRCIPHGKLCDGENDCGDNSDELDCKVSTCATVEFRCADGTCIPRSARCNQNIDCADASDEKNCNNTDCTHFYKLGVKTTGFIRCNSTSLCVLPTWICDGSNDCGDYSDELKCPVQNKHKCEENYFSCPSGRCILNTWICDGQKDCEDGRDEFHCDSSCSWNQFACSAQKCISKHWICDGEDDCGDGLDESDSICGAITCAADMFSCQGSRACVPRHWLCDGERDCPDGSDELSTAGCAPNNTCDENAFMCHNKVCIPKQFVCDHDDDCGDGSDESPQCGYRQCGTEEFSCADGRCLLNTQWQCDGDFDCPDHSDEAPLNPKCKSAEQSCNSSFFMCKNGRCIPSGGLCDNKDDCGDGSDERNCHINECLSKKVSGCSQDCQDLPVSYKCKCWPGFQLKDDGKTCVDIDECSSGFPCSQQCINTYGTYKCLCTDGYEIQPDNPNGCKSLSDEEPFLILADHHEIRKISTDGSNYTLLKQGLNNVIAIDFDYREEFIYWIDSSRPNGSRINRMCLNGSDIKVVHNTAVPNALAVDWIGKNLYWSDTEKRIIEVSKLNGLYPTILVSKRLKFPRDLSLDPQAGYLYWIDCCEYPHIGRVGMDGTNQSVVIETKISRPMALTIDYVNRRLYWADENHIEFSNMDGSHRHKVPNQDIPGVIALTLFEDYIYWTDGKTKSLSRAHKTSGADRLSLIYSWHAITDIQVYHSYRQPDVSKHLCMINNGGCSHLCLLAPGKTHTCACPTNFYLAADNRTCLSNCTASQFRCKTDKCIPFWWKCDTVDDCGDGSDEPDDCPEFRCQPGRFQCGTGLCALPAFICDGENDCGDNSDELNCDTHVCLSGQFKCTKNQKCIPVNLRCNGQDDCGDEEDERDCPENSCSPDYFQCKTTKHCISKLWVCDEDPDCADASDEANCDKKTCGPHEFQCKNNNCIPDHWRCDSQNDCSDNSDEENCKPQTCTLKDFLCANGDCVSSRFWCDGDFDCADGSDERNCETSCSKDQFRCSNGQCIPAKWKCDGHEDCKYGEDEKSCEPASPTCSSREYICASDGCISASLKCNGEYDCADGSDEMDCVTECKEDQFRCKNKAHCIPIRWLCDGIHDCVDGSDEENCERGGNICRADEFLCNNSLCKLHFWVCDGEDDCGDNSDEAPDMCVKFLCPSTRPHRCRNNRICLQSEQMCNGIDECGDNSDEDHCGGKLTYKARPCKKDEFACSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSI

SEQ ID NO: 1571 - protein, 4398 aa, synthetic construct
  REGION 1..4398: note = LRP2 (P98164) ECD
QECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEGSTTECDAAIELPINLPPPCRCMHGGNCYFDETDLPKCKCPSGYTGKYCEMAFSKGISPGTT

SEQ ID NO: 1572 - protein, 460 aa, synthetic construct
  REGION 1..460: note = LRP3 (O75074) ECD
VPALAACSGKLEQHTERRGVIYSPAWPLNYPPGTNCSWYIQGDRGDMITISFRNFDVEESHQCSLDWLLLGPAAPPRQEAFRLCGSAIPPAFISARDHVWIFFHSDASSSGQAQGFRLSYIRGKLGQASCQADEFRCDNGKCLPGPWQCNTVDECGDGSDEGNCSAPASEPPGSLCPGGTFPCSGARSTRCLPVERRCDGLQDCGDGSDEAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQGCPACPPDQYPCEGGSGLCYTPADRCNNQKSCPDGADEKNCFSCQPGTFHCGTNLCIFETWRCDGQEDCQDGSDEHGCLAAVPRK

SEQ ID NO: 1573 - protein, 1705 aa, synthetic construct
  REGION 1..1705: note = LRP4 (O75096) ECD
SSPECACGRSHFTCAVSALGECTCIPAQWQCDGDNDCGDHSDEDGCILPTCSPLDFHCDNGKCIRRSWVCDGDNDCEDDSDEQDCPPRECEEDEFPCQNGYCIRSLWHCDGDNDCGDNSDEQCDMRKCSDKEFRCSDGSCIAEHWYCDGDTDCKDGSDEENCPSAVPAPPCNLEEFQCAYGRCILDIYHCDGDDDCGDWSDESDCSSHQPCRSGEFMCDSGLCINAGWRCDGDADCDDQSDERNCTTSMCTAEQFRCHSGRCVRLSWRCDGEDDCADNSDEENCENTGSPQCALDQFLCWNGRCIGQRKLCNGVNDCGDNSDESPQQNCRPRTGEENCNVNNGGCAQKCQMVRGAVQCTCHTGYRLTEDGHTCQDVNECAEEGYCSQGCTNSEGAFQCWCETGYELRPDRRSCKALGPEPVLLFANRIDIRQVLPHRSEYTLLLNNLENAIALDFHHRRELVFWSDVTLDRILRANLNGSNVEEVVSTGLESPGGLAVDWVHDKLYWTDSGTSRIEVANLDGAHRKVLLWQNLEKPRAIALHPMEGTIYWTDWGNTPRIEASSMDGSGRRIIADTHLFWPNGLTIDYAGRRMYWVDAKHHVIERANLDGSHRKAVISQGLPHPFAITVFEDSLYWTDWHTKSINSANKFTGKNQEIIRNKLHFPMDIHTLHPQRQPAGKNRCGDNNGGCTHLCLPSGQNYTCACPTGFRKISSHACAQSLDKFLLFARRMDIRRISFDTEDLSDDVIPLADVRSAVALDWDSRDDHVYWTDVSTDTISRAKWDGTGQEVVVDTSLESPAGLAIDWVTNKLYWTDAGTDRIEVANTDGSMRTVLIWENLDRPRDIVVEPMGGYMYWTDWGASPKIERAGMDASGRQVIISSNLTWPNGLAIDYGSQRLYWADAGMKTIEFAGLDGSKRKVLIGSQLPHPFGLTLYGERIYWTDWQTKSIQSADRLTGLDRETLQENLENLMDIHVFHRRRPPVSTPCAMENGGCSHLCLRSPNPSGFSCTCPTGINLLSDGKTCSPGMNSFLIFARRIDIRMVSLDIPYFADVVVPINITMKNTIAIGVDPQEGKVYWSDSTLHRISRANLDGSQHEDIITTGLQTTDGLAVDAIGRKVYWTDTGTNRIEVGNLDGSMRKVLVWQNLDSPRAIVLYHEMGFMYWTDWGENAKLERSGMDGSDRAVLINNNLGWPNGLTVDKASSQLLWADAHTERIEAADLNGANRHTLVSPVQHPYGLTLLDSYIYWTDWQTRSIHRADKGTGSNVILVRSNLPGLMDMQAVDRAQPLGFNKCGSRNGGCSHLCLPRPSGFSCACPTGIQLKGDGKTCDPSPETYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVSHVSHPFALTQQDRWIYWTDWQTKSIQRVDKYSGRNKETVLANVEGLMDIIVVSPQRQTGTNACGVNNGGCTHLCFARASDFVCACPDEPDSRPCSLVPGLVPPAPRATGMSEKSPVLPNTPPTTLYSSTTRTRTSLEEVEGRCSERDARLGLCARSNDAVPAAPGEGLHIS

SEQ ID NO: 1574 - protein, 1353 aa, synthetic construct
  REGION 1..1353: note = LRP5 (O75197) ECD
SPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHS

SEQ ID NO: 1575 - protein, 1351 aa, synthetic construct
  REGION 1..1351: note = LRP6 (O75581) ECD
APLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAVVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQA

SEQ ID NO: 1576 - protein, 785 aa, synthetic construct
  REGION 1..785: note = LRP8 (Q14114) ECD
GPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATASQFACRSGECVHLGWRCDGDRDCKDKSDEADCPLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAA

SEQ ID NO: 1577 - protein, 517 aa, synthetic construct
  REGION 1..517: note = LRRC15 (Q8TF66) ECD
YHGCPSECTCSRASQVECTGARIVAVPTPLPWNAMSLQILNTHITELNESPFLNISALIALRIEKNELSRITPGAFRNLGSLRYLSLANNKLQVLPIGLFQGLDSLESLLLSSNQLLQIQPAHFSQCSNLKELQLHGNHLEYIPDGAFDHLVGLTKLNLGKNSLTHISPRVFQHLGNLQVLRLYENRLTDIPMGTFDGLVNLQELALQQNQIGLLSPGLFHNNHNLQRLYLSNNHISQLPPSVFMQLPQLNRLTLFGNSLKELSPGIFGPMPNLRELWLYDNHISSLPDNVFSNLRQLQVLILSRNQISFISPGAFNGLTELRELSLHTNALQDLDGNVFRMLANLQNISLQNNRLRQLPGNIFANVNGLMAIQLQNNQLENLPLGIFDHLGKLCELRLYDNPWRCDSDILPLRNWLLLNQPRLGTDTVPVCFSPANVRGQSLIIINVNVAVPSVHVPEVPSYPETPWYPDTPSYPDTTSVSSTTELTSPVEDYTDLTTIQVTDDRSVWGMTQAQSG

SEQ ID NO: 1578 - protein, 246 aa, synthetic construct
  REGION 1..246: note = LRRC19 (Q9H756) ECD
SKREVQCNFTEKNYTLIPADIKKDVTILDLSYNQITLNGTDTRVLQTYFLLTELYLIENKVTILHNNGFGNLSSLEILNICRNSIYVIQQGAFLGLNKLKQLYLCQNKIEQLNADVFVPLRSLKLLNLQGNLISYLDVPPLFHLELITLYGNLWNCSCSLFNLQNWLNTSNVTLENENITMCSYPNSLQSYNIKTVPHKAECHSKFPSSVTEDLYIHFQPISNSIFNSSSNNLTRNSEHEPLGKSW

SEQ ID NO: 1579 - protein, 385 aa, synthetic construct
  REGION 1..385: note = LRRC24 (Q50LG9) ECD
AGCPAACRCYSATVECGALRLRVVPLGIPPGTQTLFLQDNNIARLEPGALAPLAALRRLYLHNNSLRALEAGAFRAQPRLLELALTSNRLRGLRSGAFVGLAQLRVLYLAGNQLARLLDFTFLHLPRLQELHLQENSIELLEDQALAGLSSLALLDLSRNQLGTISREALQPLASLQVLRLTENPWRCDCALHWLGAWIKEGGQRLLTSRDRKIMCAEPPRLALQSLLDVSHSSLICIPPSVHVQPLELTANLGEDLRVACQASGYPQPLVTWRKVPQPREGRPRAQAQLEGGLLGLGGHSASDTGSGMLFLSNITLAHAGKYECEASNAGGAARVPFRLLVNASRQQPQQPAQPPPPAARPAGSEPRPEAGSMAFRALGVATQT

SEQ ID NO: 1580 - protein, 145 aa, synthetic construct
  REGION 1..145: note = LRRC25 (Q8N386) ECD
LEPSCTVSSADVDWNAEFSATCLNFSGLSLSLPHNQSLRASNVILLDLSGNGLRELPVTFFAHLQKLEVLNVLRNPLSRVDGALAARCDLDLQADCNCALESWHDIRRDNCSGQKPLLCWDTTSSQHNLSAFLEVSCAPGLASAT

SEQ ID NO: 1581 - protein, 608 aa, synthetic construct
  REGION 1..608: note = LRRC32 (Q14392) ECD
HQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLMDIEDGAFEGLPRLTHLNLSRNSLTCISDFSLQQLRVLDLSCNSIEAFQTASQPQAEFQLTWLDLRENKLLHFPDLAALPRLIYLNLSNNLIRLPTGPPQDSKGIHAPSEGWSALPLSAPSGNASGRPLSQLLNLDLSYNEIELIPDSFLEHLTSLCFLNLSRNCLRTFEARRLGSLPCLMLLDLSHNALETLELGARALGSLRTLLLQGNALRDLPPYTFANLASLQRLNLQGNRVSPCGGPDEPGPSGCVAFSGITSLRSLSLVDNEIELLRAGAFLHTPLTELDLSSNPGLEVATGALGGLEASLEVLALQGNGLMVLQVDLPCFICLKRLNLAENRLSHLPAWTQAVSLEVLDLRNNSFSLLPGSAMGGLETSLRRLYLQGNPLSCCGNGWLAAQLHQGRVDVDATQDLICRFSSQEEVSLSHVRPEDCEKGGLKNIN

SEQ ID NO: 1582 - protein, 1547 aa, synthetic construct
  REGION 1..1547: note = LRRC37A (A6NMS7) ECD
EAQPLEWVKDPLQLTSNPLGPPESWSSHSSHFPRESPHAPTLPADPWDFDHLGPSASSEMPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLTSPAPREVEQPHTQQGPEKLAGNAVYTKPSFTQEHKAAVSVLKPFSKGTPSTSSPAKALPQVRDRSKDLTHAISILESAKARVTNTKTSKPIVHARKKYRFHKTRSHVTHRTTKVKKSPKVRKKSYLSRLMLANRLPFSAAKSLINSPSQGAFSSLGDLSPQENPFLEVSALSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKL

SEQ ID NO: 1583 - protein, 1547 aa, synthetic construct
  REGION 1..1547: note = LRRC37A2 (A6NM11) ECD
EAQPLEWVKDPLQLTSNPLGPPDSWSSHSSHFPRESPHAPTLPADPWDFDHLGPSASSEMPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETRHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIENNNTKHTTARNAFEENDFMENTNMPEGTISENTNYNHPHEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKL

SEQ ID NO: 1584 - protein, 1546 aa, synthetic construct
  REGION 1..1546: note = LRRC37A3 (O60309) ECD
EAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIHQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESSREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQLPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLIVPSHMACCLCQFKNSIEAVCKTVKLHCNSACLTNTTHCPEEASVGNPEGAFMKVLQARKNYTSTELIIEPEEPSDSSGINLSGFGSEQLDTNDESDVTSTLSYILPYFSAVNLDVKSLLLPFIKLPTTGNSLAKIQTVGKNRQRLNRVLMGPRSIQKRHFKEVGRQSIRREQGAQASVENTAEEKRLGSPAPRELKQPHTQQGPEKLAGNAVYTKPSFTQEHKAAVSVLKPFSKGAPSTSSPAKALPQVRDRWKDLTHAISILESAKARVTNMKTSKPIVHSRKKYRFHKTRSRMTHRTPKVKKSPKVRKKSYLSRLMLSNRLPFSAAKSLINSPSQGAFSSLRDLSPQENPFLEVSAPSEHFIENNNTKDTTARNAFEENVFMENTNMPEGTISENTNYNHPPEADSAGTAFNLGPTVKQTETKWEYNNVGTDLSPEPKSFNYPLLSSPGDQFEIQLTQQLQSVIPNNNVRRLIAHVIRTLKMDCSGAHVQVTCAKLVSRTGHLMKLLSGQQEVKASKIEWDTDQWKTENYINESTEAQSEQKEKSLEFTKELPGYGYTKK

SEQ ID NO: 1585 - protein, 878 aa, synthetic construct
  REGION 1..878: note = LRRC37B (Q96QE4) ECD
LVWVKDPLQLTSNPLGPPEPWSSRSSHLPWESPHAPAPPAAPGDFDYLGPSASSQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLDLSCNKIRYIERQTFESLPFLQYINLGCNLITKLSLGTFQAWHGMQFLHNLILNRNPLTTVEDPYLFELPALKYLDMGTTHITLTTLKNILTMTVELEKLILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNK

SEQ ID NO: 1586 - protein, 222 aa, synthetic construct
  REGION 1..222: note = LRRC38 (Q5VT99) ECD
CPAGCACTDPHTVDCRDRGLPSVPDPFPLDVRKLLVAGNRIQRIPEDFFIFYGDLVYLDFRNNSLRSLEEGTFSGSAKLVFLDLSYNNLTQLGAGAFRSAGRLVKLSLANNNLVGVHEDAFETLESLQVLELNDNNLRSLSVAALAALPALRSLRLDGNPWLCDCDFAHLFSWIQENASKLPKGLDEIQCSLPMESRRISLRELSEASFSECRFSLSLTDLC

SEQ ID NO: 1587 - protein, 171 aa, synthetic construct
  REGION 1..171: note = LRRC3B (Q96PB8) ECD
CPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASNHETAHNVICKTSVLDEHAGRPFLNAANDADLCNLPKKTTDY

SEQ ID NO: 1588 - protein, 489 aa, synthetic construct
  REGION 1..489: note = LRRC4 (Q9HBW1) ECD
ASAGPQNCPSVCSCSNQFSKVVCTRRGLSEVPQGIPSNTRYLNLMENNIQMIQADTFRHLHHLEVLQLGRNSIRQIEVGAFNGLASLNTLELFDNWLTVIPSGAFEYLSKLRELWLRNNPIESIPSYAFNRVPSLMRLDLGELKKLEYISEGAFEGLFNLKYLNLGMCNIKDMPNLTPLVGLEELEMSGNHFPEIRPGSFHGLSSLKKLWVMNSQVSLIERNAFDGLASLVELNLAHNNLSSLPHDLFTPLRYLVELHLHHNPWNCDCDILWLAWWLREYIPTNSTCCGRCHAPMHMRGRYLVEVDQASFQCSAPFIMDAPRDLNISEGRMAELKCRTPPMSSVKWLLPNGTVLSHASRHPRISVLNDGTLNFSHVLLSDTGVYTCMVTNVAGNSNASAYLNVSTAELNTSNYSFFTTVTVETTEISPEDTTRKYKPVPTTSTGYQPAYTTSTTVLIQTTRVPKQVAVPATDTTDKMQTSLDEVMKTTK

SEQ ID NO: 1589 - protein, 541 aa, synthetic construct
  REGION 1..541: note = LRRC4B (Q9NT99) ECD
AGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHRLERVHLNHNPWHCNCDVLWLSWWLKETVPSNTTCCARCHAPAGLKGRYIGELDQSHFTCYAPVIVEPPTDLNVTEGMAAELKCRTGTSMTSVNWLTPNGTLMTHGSYRVRISVLHDGTLNFTNVTVQDTGQYTCMVTNSAGNTTASATLNVSAVDPVAAGGTGSGGGGPGGSGGVGGGSGGYTYFTTVTVETLETQPGEEALQPRGTEKEPPGPTTDGVWGGGRPGDAAGPASSSTTAPAPRSSRPTEKAFTVPITDVTENALKDLDDVMKTTK

SEQ ID NO: 1590 - protein, 483 aa, synthetic construct
  REGION 1..483: note = LRRC4C (Q9HCJ2) ECD
QTCPSVCSCSNQFSKVICVRKNLREVPDGISTNTRLLNLHENQIQIIKVNSFKHLRHLEILQLSRNHIRTIEIGAFNGLANLNTLELFDNRLTTIPNGAFVYLSKLKELWLRNNPIESIPSYAFNRIPSLRRLDLGELKRLSYISEGAFEGLSNLRYLNLAMCNLREIPNLTPLIKLDELDLSGNHLSAIRPGSFQGLMHLQKLWMIQSQIQVIERNAFDNLQSLVEINLAHNNLTLLPHDLFTPLHHLERIHLHHNPWNCNCDILWLSWWIKDMAPSNTACCARCNTPPNLKGRYIGELDQNYFTCYAPVIVEPPADLNVTEGMAAELKCRASTSLTSVSWITPNGTVMTHGAYKVRIAVLSDGTLNFTNVTVQDTGMYTCMVSNSVGNTTASATLNVTAATTTPFSYFSTVTVETMEPSQDEARTTDNNVGPTPVVDWETTNVTTSLTPQSTRSTEKTFTIPVTDINSGIPGIDEVMKTTK

SEQ ID NO: 1591 - protein, 221 aa, synthetic construct
  REGION 1..221: note = LRRC52 (Q8N7C0) ECD
SKCPNNCLCQAQEVICTGKQLTEYPLDIPLNTRRLFLNENRITSLPAMHLGLLSDLVYLDCQNNRIREVMDYTFIGVFKLIYLDLSSNNLTSISPFTFSVLSNLVQLNIANNPHLLSLHKFTFANTTSLRYLDLRNTGLQTLDSAALYHLTTLETLFLSGNPWKCNCSFLDFAIFLIVFHMDPSDDLNATCVEPTELTGWPITRVGNPLRYMCITHLDHKD

SEQ ID NO: 1592 - protein, 606 aa, synthetic construct
  REGION 1..606: note = LRRN1 (Q6UXK5) ECD
SIQNSECPQLCVCEIRPWFTPQSTYREATTVDCNDLRLTRIPSNLSSDTQVLLLQSNNIAKTVDELQQLFNLTELDFSQNNFTNIKEVGLANLTQLTTLHLEENQITEMTDYCLQDLSNLQELYINHNQISTISAHAFAGLKNLLRLHLNSNKLKVIDSRWFDSTPNLEILMIGENPVIGILDMNFKPLANLRSLVLAGMYLTDIPGNALVGLDSLESLSFYDNKLVKVPQLALQKVPNLKFLDLNKNPIHKIQEGDFKNMLRLKELGINNMGELVSVDRYALDNLPELTKLEATNNPKLSYIHRLAFRSVPALESLMLNNNALNAIYQKTVESLPNLREISIHSNPLRCDCVIHWINSNKTNIRFMEPLSMFCAMPPEYKGHQVKEVLIQDSSEQCLPMISHDSFPNRLNVDIGTTVFLDCRAMAEPEPEIYWVTPIGNKITVETLSDKYKLSSEGTLEISNIQIEDSGRYTCVAQNVQGADTRVATIKVNGTLLDGTQVLKIYVKQTESHSILVSWKVNSNVMTSNLKWSSATMKIDNPHITYTARVPVDVHEYNLTHLQPSTDYEVCLTVSNIHQQTQKSCVNVTTKNAAFAVDISDQETSTA

SEQ ID NO: 1593 - protein, 612 aa, synthetic construct
  REGION 1..612: note = LRRN2 (O75325) ECD
AVPVVPWHVPCPPQCACQIRPWYTPRSSYREATTVDCNDLFLTAVPPALPAGTQTLLLQSNSIVRVDQSELGYLANLTELDLSQNSFSDARDCDFHALPQLLSLHLEENQLTRLEDHSFAGLASLQELYLNHNQLYRIAPRAFSGLSNLLRLHLNSNLLRAIDSRWFEMLPNLEILMIGGNKVDAILDMNFRPLANLRSLVLAGMNLREISDYALEGLQSLESLSFYDNQLARVPRRALEQVPGLKFLDLNKNPLQRVGPGDFANMLHLKELGLNNMEELVSIDKFALVNLPELTKLDITNNPRLSFIHPRAFHHLPQMETLMLNNNALSALHQQTVESLPNLQEVGLHGNPIRCDCVIRWANATGTRVRFIEPQSTLCAEPPDLQRLPVREVPFREMTDHCLPLISPRSFPPSLQVASGESMVLHCRALAEPEPEIYWVTPAGLRLTPAHAGRRYRVYPEGTLELRRVTAEEAGLYTCVAQNLVGADTKTVSVVVGRALLQPGRDEGQGLELRVQETHPYHILLSWVTPPNTVSTNLTWSSASSLRGQGATALARLPRGTHSYNITRLLQATEYWACLQVAFADAHTQLACVWARTKEATSCHRALGDRPG

SEQ ID NO: 1594 - protein, 606 aa, synthetic construct
  REGION 1..606: note = LRRN3 (Q9H3W5) ECD
VDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPINRIRRGDFSNMLHLKELGINNMPELISIDSLAVDNLPDLRKIEATNNPRLSYIHPNAFFRLPKLESLMLNSNALSALYHGTIESLPNLKEISIHSNPIRCDCVIRWMNMNKTNIRFMEPDSLFCVDPPEFQGQNVRQVHFRDMMEICLPLIAPESFPSNLNVEAGSYVSFHCRATAEPQPEIYWITPSGQKLLPNTLTDKFYVHSEGTLDINGVTPKEGGLYTCIATNLVGADLKSVMIKVDGSFPQDNNGSLNIKIRDIQANSVLVSWKASSKILKSSVKWTAFVKTENSHAAQSARIPSDVKVYNLTHLNPSTEYKICIDIPTIYQKNRKKCVNVTTKGLHPDQKEYEKNNTTT

SEQ ID NO: 1595 - protein, 661 aa, synthetic construct
  REGION 1..661: note = LRRN4 (Q8WUT4) ECD
DPPQEKVPLFRVTQQGPWGSSGSNATDSPCEGLPAADATALTLANRNLERLPGCLPRTLRSLDASHNLLRALSTSELGHLEQLQVLTLRHNRIAALRWGPGGPAGLHTLDLSYNQLAALPPCTGPALSSLRALALAGNPLRALQPRAFACFPALQLLNLSCTALGRGAQGGIAEAAFAGEDGAPLVTLEVLDLSGTFLERVESGWIRDLPKLTSLYLRKMPRLTTLEGDIFKMTPNLQQLDCQDSPALASVATHIFQDTPHLQVLLFQNCNLSSFPPWTLDSSQVLSINLFGNPLTCSCDLSWLLTDAKRTVLSRAADTMCAPAAGSSGPFSASLSLSQLPGVCQSDQSTTLGASHPPCFNRSTYAQGTTVAPSAAPATRPAGDQQSVSKAPNVGSRTIAAWPHSDAREGTAPSTTNSVAGHSNSSVFPRAASTTRTQHRGEHAPELVLEPDISAASTPLASKLLGPFPTSWDRSISSPQPGQRTHATPQAPNPSLSEGEIPVLLLDDYSEEEEGRKEEVGTPHQDVPCDYHPCKHLQTPCAELQRRWRCRCPGLSGEDTIPDPPRLQGVTETTDTSALVHWCAPNSVVHGYQIRYSAEGWAGNQSVVGVIYATARQHPLYGLSPGTTYRVCVLAANRAGLSQPRSSGWRSPCAAFTTKPS

SEQ ID NO: 1596 - protein, 172 aa, synthetic construct
  REGION 1..172: note = LRRN4CL (Q8ND94) ECD
LAPQDFEEEEADETETAWPPLPAVPCDYDHCRHLQVPCKELQRVGPAACLCPGLSSPAQPPDPPRMGEVRIAAEEGRAVVHWCAPFSPVLHYWLLLWDGSEAAQKGPPLNATVRRAELKGLKPGGIYVVCVVAANEAGASRVPQAGGEGLEGADIPAFGPCSRLAVPPNPRT

SEQ ID NO: 1597 - protein, 389 aa, synthetic construct
  REGION 1..389: note = LRRTM2 (O43300) ECD
CPPKCRCEKLLFYCDSQGFHSVPNATDKGSLGLSLRHNHITELERDQFASFSQLTWLHLDHNQISTVKEDAFQGLYKLKELILSSNKIFYLPNTTFTQLINLQNLDLSFNQLSSLHPELFYGLRKLQTLHLRSNSLRTIPVRLFWDCRSLEFLDLSTNRLRSLARNGFAGLIKLRELHLEHNQLTKINFAHFLRLSSLHTLFLQWNKISNLTCGMEWTWGTLEKLDLTGNEIKAIDLTVFETMPNLKILLMDNNKLNSLDSKILNSLRSLTTVGLSGNLWECSARICALASWLGSFQGRWEHSILCHSPDHTQGEDILDAVHGFQLCWNLSTTVTVMATTYRDPTTEYTKRISSSSYHVGDKEIPTTAGIAVTTEEHFPEPDNAIFTQR

SEQ ID NO: 1598 - protein, 389 aa, synthetic construct
  REGION 1..389: note = LRRTM3 (Q86VH5) ECD
ERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIEAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHK

SEQ ID NO: 1599 - protein, 394 aa, synthetic construct
  REGION 1..394: note = LRRTM4 (Q86VH4) ECD
QRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHK

SEQ ID NO: 1600 - protein, 261 aa, synthetic construct
  REGION 1..261: note = LRTM1 (Q9HBL6) ECD
QSSTNFVDCSQQGLAEIPSHLPPQTRTLHLQDNQIHHLPAFAFRSVPWLMTLNLSNNSLSNLAPGAFHGLQHLQVLNLTQNSLLSLESRLFHSLPQLRELDLSSNNISHLPTSLGETWENLTILAVQQNQLQQLDRALLESMPSVRLLLLKDNLWKCNCHLLGLKLWLEKFVYKGGLTDGIICESPDTWKGKDLLRIPHELYQPCPLPAPDPVSSQAQWPGSAHGVVLRPPENHNAGERELLECELKPKPRPANLRHAIAT

SEQ ID NO: 1601 - protein, 275 aa, synthetic construct
  REGION 1..275: note = LRTM2 (Q8N967) ECD
LPTCPFSCKCDSRSLEVDCSGLGLTTVPPDVPAATRTLLLLNNKLSALPSWAFANLSSLQRLDLSNNFLDRLPRSIFGDLTNLTELQLRNNSIRTLDRDLLRHSPLLRHLDLSINGLAQLPPGLFDGLLALRSLSLRSNRLQNLDRLTFEPLANLQLLQVGDNPWECDCNLREFKHWMEWFSYRGGRLDQLACTLPKELRGKDMRMVPMEMFNYCSQLEDENSSAGLDIPGPPCTKASPEPAKPKPGAEPEPEPSTACPQKQRHRPASVRRAMGT

SEQ ID NO: 1602 - protein, 197 aa, synthetic construct
  REGION 1..197: note = LTBR (P36941) ECD
QAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLM

SEQ ID NO: 1603 - protein, 408 aa, synthetic construct
  REGION 1..408: note = LTK (P29376) ECD
ILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGP

SEQ ID NO: 1604 - protein, 219 aa, synthetic construct
  REGION 1..219: note = LY6G6F (Q5SQ64) ECD
ADNMQAIYVALGEAVELPCPSPPTLHGDEHLSWFCSPAAGSFTTLVAQVQVGRPAPDPGKPGRESRLRLLGNYSLWLEGSKEEDAGRYWCAVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPW

SEQ ID NO: 1605 - protein, 1639 aa, synthetic construct
  REGION 1..1639: note = LY75 (O60449) ECD
SGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLGPD

SEQ ID NO: 1606 - protein, 407 aa, synthetic construct
  REGION 1..407: note = LY9 (Q9HBG7) ECD
KDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTK

SEQ ID NO: 1607 - protein, 219 aa, synthetic construct
  REGION 1..219: note = LYVE1 (Q9Y5Y7) ECD
LVQGSLRAEELSIQVSCRIMGITLVSKKANQQLNFTEAKEACRLLGLSLAGKDQVETALKASFETCSYGWVGDGFVVISRISPNPKCGKNGVGVLIWKVPVSRQFAAYCYNSSDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPT

SEQ ID NO: 1608 - protein, 159 aa, synthetic construct
  REGION 1..159: note = M6PR (P20645) ECD
TEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISH

SEQ ID NO: 1609 - protein, 497 aa, synthetic construct
  REGION 1..497: note = MAG (P20916) ECD
GHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGP

SEQ ID NO: 1610 - protein, 1129 aa, synthetic construct
  REGION 1..1129: note = MAMDC4 (Q6UXC1) ECD
WVPNHCRSPGQAVCNFVCDCRDCSDEAQCGYHGASPTLGAPFACDFEQDPCGWRDISTSGYSWLRDRAGAALEGPGPHSDHTLGTDLGWYMAVGTHRGKEASTAALRSPTLREAASSCKLRLWYHAASGDVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRAGGPERPSWPRRDHSRNSAQGSFLVSVAEPGTPAILSSPEFQASGTSNCSLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPRGFLALVVVDNGSRELAWQALSSSAGIWKVDKVLLGARRRPFRLEFVGLVDLDGPDQQGAGVDNVTLRDCSPTVTTERDREVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAERAWRVVFEAVAAGVAHSYVALDDLLLQDGPCPQPGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGS

SEQ ID NO: 1611 - protein, 359 aa, synthetic construct
  REGION 1..359: note = MANSC1 (Q9H8J5) ECD
QNCLKKSLEDVVIDIQSSLSKGIRGNEPVYTSTQEDCINSCCSTKNISGDKACNLMIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWL

SEQ ID NO: 1612 - protein, 260 aa, synthetic construct
  REGION 1..260: note = MANSC4 (A6NHS7) ECD
SPTIFYRDCWIRRFPGLLINLEESQKLGAQFLKYYSESTGQKCSRSCCLRKDVSCNLAVFYHSPIHDNINCLHVHCPTLESCILEPGTSAILYNITDGIDPDLLVFEQSPTYLNTRSSSNRWDRLRILKAMNLDKQTTTINGMLPSTEAPSSTTHQDLVVNTNSTSYSKELTTDFWARFTSLNESITTKINKVSPSTDFISNPDNKTISPFFEPIDTKLSHMPVPPGLNSSKQLLNKTKGYNSRNHTSANEDEVSVTSKT

SEQ ID NO: 1613 - protein, 536 aa, synthetic construct
  REGION 1..536: note = MCAM (P43121) ECD
VPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRG

SEQ ID NO: 1614 - protein, 832 aa, synthetic construct
  REGION 1..832: note = MEGF10 (Q96KG7) ECD
LNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIG

SEQ ID NO: 1615 - protein, 829 aa, synthetic construct
  REGION 1..829: note = MEGF11 (A6BM72) ECD
LNPEDPNVCSHWESYAVTVQESYAHPFDQIYYTRCTDILNWFKCTRHRISYKTAYRRGLRTMYRRRSQCCPGYYESGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHS

SEQ ID NO: 1616 - protein, 2620 aa, synthetic construct
  REGION 1..2620: note = MEGF8 (Q7Z7M0) ECD
GDCKGQRQVLREAPGFVTDGAGNYSVNGNCEWLIEAPSPQHRILLDFLFLDTECTYDYLFVYDGDSPRGPLLASLSGSTRPPPIEASSGKMLLHLFSDANYNLLGFNASFRFSLCPGGCQSHGQCQPPGVCACEPGWGGPDCGLQECSAYCGSHGTCASPLGPCRCEPGFLGRACDLHLWENQGAGWWHNVSARDPAFSARIGAAGAFLSPPGLLAVFGGQDLNNALGDLVLYNFSANTWESWDLSPAPAARHSHVAVAWAGSLVLMGGELADGSLTNDVWAFSPLGRGHWELLAPPASSSSGPPGLAGHAAALVDDVWLYVSGGRTPHDLFSSGLFRFRLDSTSGGYWEQVIPAGGRPPAATGHSMVFHAPSRALLVHGGHRPSTARFSVRVNSTELFHVDRHVWTTLKGRDGLQGPRERAFHTASVLGNYMVVYGGNVHTHYQEEKCYEDGIFFYHLGCHQWVSGAELAPPGTPEGRAAPPSGRYSHVAAVLGGSVLLVAGGYSGRPRGDLMAYKVPPFVFQAPAPDYHLDYCSMYTDHSVCSRDPECSWCQGACQAAPPPGTPLGACPAASCLGLGRLLGDCQACLAFSSPTAPPRGPGTLGWCVHNESCLPRPEQARCRGEQISGTVGWWGPAPVFVTSLEACVTQSFLPGLHLLTFQQPPNTSQPDKVSIVRSTTITLTPSAETDVSLVYRGFIYPMLPGGPGGPGAEDVAVWTRAQRLHVLARMARGPDTENMEEVGRWVAHQEKETRRLQRPGSARLFPLPGRDHKYAVEIQGQLNGSAGPGHSELTLLWDRTGVPGGSEISFFFLEPYRSSSCTSYSSCLGCLADQGCGWCLTSATCHLRQGGAHCGDDGAGGSLLVLVPTLCPLCEEHRDCHACTQDPFCEWHQSTSRKGDAACSRRGRGRGALKSPEECPPLCSQRLTCEDCLANSSQCAWCQSTHTCFLFAAYLARYPHGGCRGWDDSVHSEPRCRSCDGFLTCHECLQSHECGWCGNEDNPTLGRCLQGDFSGPLGGGNCSLWVGEGLGLPVALPARWAYARCPDVDECRLGLARCHPRATCLNTPLSYECHCQRGYQGDGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTGLYGHSAVYHEATDSLYVFGGFRFHVELAAPSPELYSLHCPDRTWSLLAPSQGAKRDRMRNVRGSSRGLGQVPGEQPGSWGFREVRKKMALWAALAGTGGFLEEISPHLKEPRPRLFHASALLGDTMVVLGGRSDPDEFSSDVLLYQVNCNAWLLPDLTRSASVGPPMEESVAHAVAAVGSRLYISGGFGGVALGRLLALTLPPDPCRLLSSPEACNQSGACTWCHGACLSGDQAHRLGCGGSPCSPMPRSPEECRRLRTCSECLARHPRTLQPGDGEASTPRCKWCTNCPEGACIGRNGSCTSENDCRINQREVFWAGNCSEAACGAADCEQCTREGKCMWTRQFKRTGETRRILSVQPTYDWTCFSHSLLNVSPMPVESSPPLPCPTPCHLLPNCTSCLDSKGADGGWQHCVWSSSLQQCLSPSYLPLRCMAGGCGRLLRGPESCSLGCAQATQCALCLRRPHCGWCAWGGQDGGGRCMEGGLSGPRDGLTCGRPGASWAFLSCPPEDECANGHHDCNETQNCHDQPHGYECSCKTGYTMDNMTGLCRPVCAQGCVNGSCVEPDHCRCHFGFVGRNCSTECRCNRHSECAGVGARDHCLLCRNHTKGSHCEQCLPLFVGSAVGGGTCRPCHAFCRGNSHICISRKELQMSKGEPKKYSLDPEEIENWVTEGPSEDEAVCVNCQNNSYGEKCESCLQGYFLLDGKCTKCQCNGHADTCNEQDGTGCPCQNNTETGTCQGSSPSDRRDCYKYQCAKCRESFHGSPLGGQQCYRLISVEQECCLDPTSQTNCFHEPKRRALGPGRTVLFGVQPKFTNVDIRLTLDVTFGAVDLYVSTSYDTFVVRVAPDTGVHTVHIQPPPAPPPPPPPADGGPRGAGDPGGAGASSGPGAPAEPRVREVWPRGLITYVTVTEPSAVLVVRGVRDRLVITYPHEHHALKSSRFYLLLLGVGDPSGPGANGSADSQGLLFFRQDQAHID

SEQ ID NO: 1617 - protein, 484 aa, synthetic construct
  REGION 1..484: note = MEGF9 (Q9H1U4) ECD
AVASAASAGNVTGGGGAAGQVDASPGPGLRGEPSHPFPRATAPTAQAPRTGPPRATVHRPLAATSPAQSPETTPLWATAGPSSTTFQAPLGPSPTTPPAAERTSTTSQAPTRPAPTTLSTTTGPAPTTPVATTVPAPTTPRTPTPDLPSSSNSSVLPTPPATEAPSSPPPEYVCNCSVVGSLNVNRCNQTTGQCECRPGYQGLHCETCKEGFYLNYTSGLCQPCDCSPHGALSIPCNSSGKCQCKVGVIGSICDRCQDGYYGFSKNGCLPCQCNNRSASCDALTGACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFN

SEQ ID NO: 1618 - protein, 647 aa, synthetic construct
  REGION 1..647: note = MEP1A (Q16819) ECD
NGLRDPNTRWTFPIPYILADNLGLNAKGAILYAFEMFRLKSCVDFKPYEGESSYIIFQQFDGCWSEVGDQHVGQNISIGQGCAYKAIIEHEILHALGFYHEQSRTDRDDYVNIWWDQILSGYQHNFDTYDDSLITDLNTPYDYESLMHYQPFSFNKNASVPTITAKIPEFNSIIGQRLDFSAIDLERLNRMYNCTTTHTLLDHCTFEKANICGMIQGTRDDTDWAHQDSAQAGEVDHTLLGQCTGAGYFMQFSTSSGSAEEAALLESRILYPKRKQQCLQFFYKMTGSPSDRLVVWVRRDDSTGNVRKLVKVQTFQGDDDHNWKIAHVVLKEEQKFRYLFQGTKGDPQNSTGGIYLDDITLTETPCPTGVWTVRNFSQVLENTSKGDKLQSPRFYNSEGYGFGVTLYPNSRESSGYLRLAFHVCSGENDAILEWPVENRQVIITILDQEPDVRNRMSSSMVFTTSKSHTSPAINDTVIWDRPSRVGTYHTDCNCFRSIDLGWSGFISHQMLKRRSFLKNDDLIIFVDFEDITHLSQTEVPTKGKRLSPQGLILQGQEQQVSEEGSGKAMLEEALPVSLSQGQPSRQKRSVENTGPLEDHNWPQYFRDPCDPNPCQNDGICVNVKGMASCRCISGHAFFYTGERCQAV

SEQ ID NO: 1619 - protein, 630 aa, synthetic construct
  REGION 1..630: note = MEP1B (Q16820) ECD
TPENFDVDGGMDQDIFDINEGLGLDLFEGDIRLDRAQIRNSIIGEKYRWPHTIPYVLEDSLEMNAKGVILNAFERYRLKTCIDFKPWAGETNYISVFKGSGCWSSVGNRRVGKQELSIGANCDRIATVQHEFLHALGFWHEQSRSDRDDYVRIMWDRILSGREHNFNTYSDDISDSLNVPYDYTSVMHYSKTAFQNGTEPTIVTRISDFEDVIGQRMDFSDSDLLKLNQLYNCSSSLSFMDSCSFELENVCGMIQSSGDNADWQRVSQVPRGPESDHSNMGQCQGSGFFMHFDSSSVNVGATAVLESRTLYPKRGFQCLQFYLYNSGSESDQLNIYIREYSADNVDGNLTLVEEIKEIPTGSWQLYHVTLKVTKKFRVVFEGRKGSGASLGGLSIDDINLSETRCPHHIWHIRNFTQFIGSPNGTLYSPPFYSSKGYAFQIYLNLAHVTNAGIYFHLISGANDDQLQWPCPWQQATMTLLDQNPDIRQRMSNQRSITTDPFMTTDNGNYFWDRPSKVGTVALFSNGTQFRRGGGYGTSAFITHERLKSRDFIKGDDVYILLTVEDISHLNSTQIQLTPAPSVQDLCSKTTCKNDGVCTVRDGKAECRCQSGEDWWYMGERCEKRGSTRDT

SEQ ID NO: 1620 - protein, 485 aa, synthetic construct
  REGION 1..485: note = MERTK (Q12866) ECD
AITEAREEAKPYPLFPGPFPGSLQTDHTPLLSLPHASGYQPALMFSPTQPGRPHTGNVAIPQVTSVESKPLPPLAFKHTVGHIILSEHKGVKFNCSISVPNIYQDTTISWWKDGKELLGAHHAITQFYPDDEVTAIIASFSITSVQRSDNGSYICKMKINNEEIVSDPIYIEVQGLPHFTKQPESMNVTRNTAFNLTCQAVGPPEPVNIFWVQNSSRVNEQPEKSPSVLTVPGLTEMAVFSCEAHNDKGLTVSKGVQINIKAIPSPPTEVSIRNSTAHSILISWVPGFDGYSPFRNCSIQVKEADPLSNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLII

SEQ ID NO: 1621 - protein, 908 aa, synthetic construct
  REGION 1..908: note = MET (P08581) ECD
ECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFT

SEQ ID NO: 1622 - protein, 129 aa, synthetic construct
  REGION 1..129: note = MFAP3 (P55082) ECD
AFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYTCFVTSPIRASYSVTLRVIFTSGDM

SEQ ID NO: 1623 - protein, 121 aa, synthetic construct
  REGION 1..121: note = MFAP3L (O75121) ECD
KSVTNSTLNGTNVVLGSVPVIIARTDHIIVKEGNSALINCSVYGIPDPQFKWYNSIGKLLKEEEDEKERGGGKWQMHDSGLLNITKVSFSDRGKYTCVASNIYGTVNNTVTLRVIFTSGDM

SEQ ID NO: 1624 - protein, 284 aa, synthetic construct
  REGION 1..284: note = MICA (Q29983) ECD
EPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLAMNVRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHW

SEQ ID NO: 1625 - protein, 287 aa, synthetic construct
  REGION 1..287: note = MICB (Q29980) ECD
AEPHSLRYNLMVLSQDESVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKVLVLQSQRTD

SEQ ID NO: 1626 - protein, 208 aa, synthetic construct
  REGION 1..208: note = MILR1 (Q7Z6M3) ECD
RKAVLDCEAMKTNEFPSPCLDSKTKVVMKGQNVSMFCSHKNKSLQITYSLFRRKTHLGTQDGKGEPAIFNLSITEAHESGPYKCKAQVTSCSKYSRDFSFTIVDPVTSPVLNIMVIQTETDRHITLHCLSVNGSLPINYTFFENHVAISPAISKYDREPAEFNLTKKNPGEEEEYRCEAKNRLPNYATYSHPVTMPSTGGDSCPFCLK

SEQ ID NO: 1627 - protein, 430 aa, synthetic construct
  REGION 1..430: note = MMP14 (P50281) ECD
YAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAA

SEQ ID NO: 1628 - protein, 445 aa, synthetic construct
  REGION 1..445: note = MMP16 (P51512) ECD
YALTGQKWQHKHITYSIKNVTPKVGDPETRKAIRRAFDVWQNVTPLTFEEVPYSELENGKRDVDITIIFASGFHGDSSPFDGEGGFLAHAYFPGPGIGGDTHFDSDEPWTLGNPNHDGNDLFLVAVHELGHALGLEHSNDPTAIMAPFYQYMETDNFKLPNDDLQGIQKIYGPPDKIPPPTRPLPTVPPHRSIPPADPRKNDRPKPPRPPTGRPSYPGAKPNICDGNFNTLAILRREMFVFKDQWFWRVRNNRVMDGYPMQITYFWRGLPPSIDAVYENSDGNFVFFKGNKYWVFKDTTLQPGYPHDLITLGSGIPPHGIDSAIWWEDVGKTYFFKGDRYWRYSEEMKTMDPGYPKPITVWKGIPESPQGAFVHKENGFTYFYKGKEYWKFNNQILKVEPGYPRSILKDFMGCDGPTDRVKEGHSPPDDVDIVIKLDNTASTVKA

SEQ ID NO: 1629 - protein, 638 aa, synthetic construct
  REGION 1..638: note = MPEG1 (Q2M385) ECD
KSGKPSGEMDEVGVQKCKNALKLPVLEVLPGGGWDNLRNVDMGRVMELTYSNCRTTEDGQYIIPDEIFTIPQKQSNLEMNSEILESWANYQSSTSYSINTELSLFSKVNGKFSTEFQRMKTLQVKDQAITTRVQVRNLVYTVKINPTLELSSGFRKELLDISDRLENNQTRMATYLAELLVLNYGTHVTTSVDAGAALIQEDHLRASFLQDSQSSRSAVTASAGLAFQNTVNFKFEENYTSQNVLTKSYLSNRTNSRVQSIGGVPFYPGITLQAWQQGITNHLVAIDRSGLPLHFFINPNMLPDLPGPLVKKVSKTVETAVKRYYTFNTYPGCTDLNSPNFNFQANTDDGSCEGKMTNFSFGGVYQECTQLSGNRDVLLCQKLEQKNPLTGDFSCPSGYSPVHLLSQIHEEGYNHLECHRKCTLLVFCKTVCEDVFQVAKAEFRAFWCVASSQVPENSGLLFGGLFSSKSINPMTNAQSCPAGYFPLRLFENLKVCVSQDYELGSRFAVPFGGFFSCTVGNPLVDPAISRDLGAPSLKKCPGGFSQHPALISDGCQVSYCVKSGLFTGGSLPPARLPPFTRPPLMSQAATNTVIVTNSENARSWIKDSQTHQWRLGEPIELRRAMNVIHGDGGGLSGG

SEQ ID NO: 1630 - protein, 466 aa, synthetic construct
  REGION 1..466: note = MPL (P40238) ECD
QDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAW

SEQ ID NO: 1631 - protein, 124 aa, synthetic construct
  REGION 1..124: note = MPZ (P25189) ECD
IVVYTDREVHGAVGSRVTLHCSFWSSEWVSDDISFTWRYQPEGGRDAISIFHYAKGQPYIDEVGTFKERIQWVGDPRWKDGSIVIHNLDYSDNGTFTCDVKNPPDIVGKTSQVTLYVFEKVPTR

SEQ ID NO: 1632 - protein, 127 aa, synthetic construct
  REGION 1..127: note = MPZL1 (O95297) ECD
SALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPV

SEQ ID NO: 1633 - protein, 128 aa, synthetic construct
  REGION 1..128: note = MPZL2 (O60487) ECD
VEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFL

SEQ ID NO: 1634 - protein, 127 aa, synthetic construct
  REGION 1..127: note = MPZL3 (Q6UWV2) ECD
LEIRADAHVRGYVGEKIKLKCTFKSTSDVTDKLTIDWTYRPPSSSHTVSIFHYQSFQYPTTAGTFRDRISWVGNVYKGDASISISNPTIKDNGTFSCAVKNPPDVHHNIPMTELTVTERGFGTMLSS

SEQ ID NO: 1635 - protein, 280 aa, synthetic construct
  REGION 1..280: note = MR1 (Q95460) ECD
RTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVM

SEQ ID NO: 1636 - protein, 1371 aa, synthetic construct
  REGION 1..1371: note = MRC1 (P22897) ECD
LLDTRQFLIYNEDHKRCVDAVSPSAVQTAACNQDAESQKFRWVSESQIMSVAFKLCLGVPSKTDWVAITLYACDSKSEFQKWECKNDTLLGIKGEDLFFNYGNRQEKNIMLYKGSGLWSRWKIYGTTDNLCSRGYEAMYTLLGNANGATCAFPFKFENKWYADCTSAGRSDGWLWCGTTTDYDTDKLFGYCPLKFEGSESLWNKDPLTSVSYQINSKSALTWHQARKSCQQQNAELLSITEIHEQTYLTGLTSSLTSGLWIGLNSLSFNSGWQWSDRSPFRYLNWLPGSPSAEPGKSCVSLNPGKNAKWENLECVQKLGYICKKGNTTLNSFVIPSESDVPTHCPSQWWPYAGHCYKIHRDEKKIQRDALTTCRKEGGDLTSIHTIEELDFIISQLGYEPNDELWIGLNDIKIQMYFEWSDGTPVTFTKWLRGEPSHENNRQEDCVVMKGKDGYWADRGCEWPLGYICKMKSRSQGPEIVEVEKGCRKGWKKHHFYCYMIGHTLSTFAEANQTCNNENAYLTTIEDRYEQAFLTSFVGLRPEKYFWTGLSDIQTKGTFQWTIEEEVRFTHWNSDMPGRKPGCVAMRTGIAGGLWDVLKCDEKAKFVCKHWAEGVTHPPKPTTTPEPKCPEDWGASSRTSLCFKLYAKGKHEKKTWFESRDFCRALGGDLASINNKEEQQTIWRLITASGSYHKLFWLGLTYGSPSEGFTWSDGSPVSYENWAYGEPNNYQNVEYCGELKGDPTMSWNDINCEHLNNWICQIQKGQTPKPEPTPAPQDNPPVTEDGWVIYKDYQYYFSKEKETMDNARAFCKRNFGDLVSIQSESEKKFLWKYVNRNDAQSAYFIGLLISLDKKFAWMDGSKVDYVSWATGEPNFANEDENCVTMYSNSGFWNDINCGYPNAFICQRHNSSINATTVMPTMPSVPSGCKEGWNFYSNKCFKIFGFMEEERKNWQEARKACIGFGGNLVSIQNEKEQAFLTYHMKDSTFSAWTGLNDVNSEHTFLWTDGRGVHYTNWGKGYPGGRRSSLSYEDADCVVIIGGASNEAGKWMDDTCDSKRGYICQTRSDPSLTNPPATIQTDGFVKYGKSSYSLMRQKFQWHEAETYCKLHNSLIASILDPYSNAFAWLQMETSNERVWIALNSNLTDNQYTWTDKWRVRYTNWAADEPKLKSACVYLDLDGYWKTAHCNESFYFLCKRSDEIPATEPPQLPGRCPESDHTAWIPFHGHCYYIESSYTRNWGQASLECLRMGSSLVSIESAAESSFLSYRVEPLKSKTNFWIGLFRNVEGTWLWINNSPVSFVNWNTGDPSGERNDCVALHASSGFWSNIHCSSYKGYICKRPKIIDAKPTHELLTTKADTRKMDPSKPSSNVA

SEQ ID NO: 1637 - protein, 1384 aa, synthetic construct
  REGION 1..1384: note = MRC2 (Q9UBG0) ECD
GAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKGWTWHSPSCYWLGEDQVTYSEARRLCTDHGSQLVTITNRFEQAFVSSLIYNWEGEYFWTALQDLNSTGSFFWLSGDEVMYTHWNRDQPGYSRGGCVALATGSAMGLWEVKNCTSFRARYICRQSLGTPVTPELPGPDPTPSLTGSCPQGWASDTKLRYCYKVFSSERLQDKKSWVQAQGACQELGAQLLSLASYEEEHFVANMLNKIFGESEPEIHEQHWFWIGLNRRDPRGGQSWRWSDGVGFSYHNFDRSRHDDDDIRGCAVLDLASLQWVAMQCDTQLDWICKIPRGTDVREPDDSPQGRREWLRFQEAEYKFFEHHSTWAQAQRICTWFQAELTSVHSQAELDFLSHNLQKFSRAQEQHWWIGLHTSESDGRFRWTDGSIINFISWAPGKPRPVGKDKKCVYMTASREDWGDQRCLTALPYICKRSNVTKETQPPDLPTTALGGCPSDWIQFLNKCFQVQGQEPQSRVKWSEAQFSCEQQEAQLVTITNPLEQAFITASLPNVTFDLWIGLHASQRDFQWVEQEPLMYANWAPGEPSGPSPAPSGNKPTSCAVVLHSPSAHFTGRWDDRSCTEETHGFICQKGTDPSLSPSPAALPPAPGTELSYLNGTFRLLQKPLRWHDALLLCESRNASLAYVPDPYTQAFLTQAARGLRTPLWIGLAGEEGSRRYSWVSEEPLNYVGWQDGEPQQPGGCTYVDVDGAWRTTSCDTKLQGAVCGVSSGPPPPRRISYHGSCPQGLADSAWIPFREHCYSFHMELLLGHKEARQRCQRAGGAVLSILDEMENVFVWEHLQSYEGQSRGAWLGMNFNPKGGTLVWQDNTAVNYSNWGPPGLGPSMLSHNSCYWIQSNSGLWRPGACTNITMGVVCKLPRAEQSSFSPSALPENPAA

SEQ ID NO: 1638 - protein, 843 aa, synthetic construct
  REGION 1..843: note = MRVI1 (Q9Y6F6) ECD
MGMDLTCPFGISPACGAQASWSIFGADAAEVPGTRGHSQQEAAMPHIPEDEEPPGEPQAAQSPAGQGPPAAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQH

SEQ ID NO: 1639 - protein, 603 aa, synthetic construct
  REGION 1..603: note = MSLNL (Q96KJ4) ECD
KVLSPGGLDASGANLWASANCSLLQGFWCQPASQLPRDQLSALIQRLALLQVPLQAWQLSCLANLASRCGLQDDFTLHPPNLLLFYNLSQVREADCRAFIRRAAQGDVELLSHLPDQRVALWRAAVACLVGAGLRLSASDQQLLGALVCDMDASSIGAADPHMLENLRRCPRLTAAQRIALNSLLAGGKTSLGPPGSWTLEGLQALGPLATYISPHLWAQVQEAVGLGFFRSVVASCQVGRLGQREARCFVTSFLESKTKPVSSRPRLSTGNITAATLRDDLFLVHYDCAELESCLDGCILRTNLDTLLQHLLPTECQHVVKAKLAQIYPQGLPEDQLRLITSLVYLYSRTEIGQWSITSQDTVMALLASDVALENQTEAVLQKFLEHNGTVSGALLLAIGGTRLCWMSPHQIQTIHPQELRLAGALDLSSCPQSRKDVLYTKAHETFGSSGTLAAYYRLMRPYLGGSPGGAQPPSPVPPGGAPVEELRHLAHANISMDIDTFTSLNPLELQSLDVGNVTALLGHNVGDLQKARSHPTVRAWLRSLNSSTLGQLGLDASPTSPTGPAHGTRGPPSTTHQVLHLVHTSGLPTNDAQASTSGSLW

SEQ ID NO: 1640 - protein, 933 aa, synthetic construct
  REGION 1..933: note = MST1R (Q04912) ECD
EDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIQGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVCVDGECHILGRVVRPGPDGVPQST

SEQ ID NO: 1641 - protein, 1135 aa, synthetic construct
  REGION 1..1135: note = MUC1 (P15941) ECD
SGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPG

SEQ ID NO: 1642 - protein, 5364 aa, synthetic construct
  REGION 1..5364: note = MUC12 (Q9UKN1) ECD
VTTVTPEGSAVHKAISQQGTLWTGEVLEKQTVEQGKSTLRRQKNHFHRSAGELRCRNALKDEGASAGWSVMFAGESVVVLVHLWMTGARVKNLGLVEFASPGDDGDGRAEGFSLGLPLSEQARAAGAREKERQETVINHSTFSGFSQITGSTVNTSIGGNTTSASTPSSSDPFTTFSDYGVSVTFITGSTATKHFLDSSTNSGHSEESTVSHSGPGATGTTLFPSHSATSVFVGEPKTSPITSASMETTALPGSTTTAGLSEKSTTFYSSPRSPDRTLSPARTTSSGVSEKSTTSHSRPGPTHTIAFPDSTTMPGVSQESTASHSIPGSTDTTLSPGTTTPSSLGPESTTFHSSPGYTKTTRLPDNTTTSGLLEASTPVHSSTGSPHTTLSPSSSTTHEGEPTTFQSWPSSKDTSPAPSGTTSAFVKLSTTYHSSPSSTPTTHFSASSTTLGHSEESTPVHSSPVATATTPPPARSATSGHVEESTAYHRSPGSTQTMHFPESSTTSGHSEESATFHGSTTHTKSSTPSTTAALAHTSYHSSLGSTETTHFRDSSTISGRSEESKASHSSPDAMATTVLPAGSTPSVLVGDSTPSPISSGSMETTALPGSTTKPGLSEKSTTFYSSPRSPDTTHLPASMTSSGVSEESTTSHSRPGSTHTTAFPGSTTMPGLSQESTASHSSPGPTDTTLSPGSTTASSLGPEYTTFHSRPGSTETTLLPDNTTASGLLEASMPVHSSTRSPHTTLSPAGSTTRQGESTTFHSWPSSKDTRPAPPTTTSAFVEPSTTSHGSPSSIPTTHISARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSERSTTFHSSPRSPATTLSPASTTSSGVSEESTTSRSRPGSTHTTAFPDSTTTPGLSRHSTTSHSSPGSTDTTLLPASTTTSGPSQESTTSHSSSGSTDTALSPGSTTALSFGQESTTFHSNPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSRGSTETTVFPHSTTTSVHGEEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSDLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPSSKDTMPAPPTTTSAFVELSTTSHGSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRTPTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTTFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTASHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSGPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGSSQESTTSHSSSGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRREEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSTGLQEESTTFQSWPSSSDTTPSPPSTTAVPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSMHTTAFPSSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESNTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSIATTHFPESSTTSGRSEESTASHSSPDTNGITPLPAHFTTSGRIAESTTFYISPGSMETTLASTATTPGLSAKSTILYSSSRSPDQTLSPASMTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLTEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVY

SEQ ID NO: 1643 - protein, 403 aa, synthetic construct
  REGION 1..403: note = MUC13 (Q9H3R2) ECD
TNQGNSADAVTTTETATSGPTVAAADTTETNFPETASTTANTPSFPTATSPAPPIISTHSSSTIPTPAPPIISTHSSSTIPIPTAADSESTTNVNSLATSDIITASSPNDGLITMVPSETQSNNEMSPTTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVASSLKCPDACNAQHKQCLIKKSGGAPECACVPGYQEDANGNCQKCAFGYSGLDCKDKFQL

SEQ ID NO: 1644 - protein, 213 aa, synthetic construct
  REGION 1..213: note = MUC15 (Q8N387) ECD
KENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNT

SEQ ID NO: 1645 - protein, 4368 aa, synthetic construct
  REGION 1..4368: note = MUC17 (Q685J3) ECD
EQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYG

SEQ ID NO: 1646 - protein, 455 aa, synthetic construct
  REGION 1..455: note = MUC21 (Q5SSG8) ECD
NETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWE

SEQ ID NO: 1647 - protein, 1634 aa, synthetic construct
  REGION 1..1634: note = MUC22 (E2RYF6) ECD
NTTAFTKGSDTTTASITGSETTMASTMASTSALTTGSKITTDSTTGSETTSASTMASTAAFTTGSETNTASTTDSGTTIASTRTFTTGSDTTTGSTAGSETIVASTTVSGTTTTFTIASTTVPETTMASSTTSTAGSEKTMASSIISETTMASTTGSETATVSTTGSETTTTSTASSEATKVSTTGSETTTASTAGSETTTTSTSMAGSEATTTSTADSKVITASSMSSETTVAPAAGSNTTTASTTGSETTTILIKASETTTASTAGSETTTPSPTGSQTTIVSISGSEITTTSTAGSENTTVSSAGSGTTTASMAGSETTVSTAGSETTTVSITGTETTMVSAMGSETTTNSTTSSETTVTSTAGSETTTVSTVGSETTTAYTADSETTAASTTGSEMTTVFTAGSETITPSTAGSETTTVSTAGSETTTVSTTGSETTTASTAHSETTAASTMGSETTKVSTAGSETTVSTAGSETTAASTEDSETNTAFTEDSKTTTASTTGFETTAASTTGSEPTMASTMGSETTMASTIGPETTKVSTASSEVTTVFAAGSETIRASTVGSETTTVSTTGSETTTASIMGSETSTDSTTGSETTTASTEGSETTTASTEGSEATTVSTTGSETTTVSITDSETTTTCTEGSEMTAVSTTVFETTTASTEGSEITIASTSDSETTTASTEGSETTTVTTAGSETKTAYTTGSETTTASNTGLETTTVFTIGSDTTTASTEGSETTAVSATGSEMTTVSTEGSENTTVSTTGSETTTVSTTGLETTTTSTEGSEMTTVSTTGAETTTDSTEGSGTTAASTAGSETTTVSTADSENTTASTADSETTSASTTGSETTTASTTSSETTTASTEGSETTTVSTTDSETTMVSTTGSERTITSTEGSETTTVSATGSETTVSTEGSGTTTVSITGSETTKVSTTGSETTTTSTEGSEITTASITGSETTTASTEGSETTTASTEGSETTSASTTGSETTTASTTSSETTMASIMGSETTMASTIGSETTKVSTASSKMTTVFTENSETTIASTTASETTTVSTAGSETIPASTAGSETTTTTSTEGSETTTASTEGSETTTASTESSETTTATTIGSETTTASTEGSETTTTSTEGSETTTASTEGSEITTVSTTGSETTTASTEGSETTTASTEGSELTTVSTTGSETITVSAEGSETTTVTTMGSETTTASTAGSETTTVSTAGSETTTASIEGSETTTVSSTGSETTTVSTTGTETTITSTEGSETTTVTTAGSETTAVYTTGSETTTTSTEGSETTTVSTTGSETTTASTADLETTTVSTSGSGTTTASTAGSETTTVYITGSKTTTASTEGSEATTVSTTSSETTTASTTGSEMTTVFTTVSETTTVSTIGSEATTSSAAGSEATTTSTEGSETTTASTAGSETTTASTAGSETTTASTSGSETNTACTTGSETSTPSSAGSETNTAFIIGSESTIASTASLEPTATSLTGSETTTVSITASGATAASTTVSSTTFVLTKATDVSIQPITNTPMSGTRTTGTRLTASSSVTMAPGMDFTASAASHTVPGIVLNTSGLGTSTMGASSTTSAHGVRTTTGSTREPTSSTFQETGPVSMGTNTVSMSHTPTNVIKPSGYLQP

SEQ ID NO: 1648 - protein, 3211 aa, synthetic construct
  REGION 1..3211: note = MUC3A (Q02505) ECD
SPWATGTLSTATSISQVPFPRAEAASAVLSNSPHSRDLAGWPLGVPQLASPAPGHRENAPMTLTTSPHDTLISETLLNSPVSSNTSTTPTSKFAFKVETTPPTVLVYSATTECVYPTSFIITISHPTSICVTTTQVAFTSSYTSTPVTQKPVTTVTSTYSMTTTEKGTSAMTSSPSTTTARETPIVTVTPSSVSATDTTFHTTISSTTRTTERTPLPTGSIHTTTSPTPVFTTLKTAVTSTSPITSSITSTNTVTSMTTTASQPTATNTLSSPTRTILSSTPVLSTETITSGITNTTPLSTLVTTLPTTISRSTPTSETTYTTSPTSTVTDSTTKIAYSTSMTGTLSTETSLPPTSSSLPTTETATTPMTNLVTTTTEISSHSTPSFSSSTIYSTVSTSTTAISSLPPTSGTMVTSTTMTPSSLSTDIPFTTPTTITHHSVGSTGFLTTATDLTSTFTVSSSSAMSTSVIPSSPSIQNTETSSLVSMTSATTPNVRPTFVSTLSTPTSSLLTTFPATYSFSSSMSASSAGTTHTESISSPPASTSTLHTTAESTLAPTTTTSFTTSTTMEPPSTTAATTGTGQTTFTSSTATFPETTTPTPTTDMSTESLTTAMTSPPITSSVTSTNTVTSMTTTTSPPTTTNSFTSLTSMPLSSTPVPSTEVVTSGTINTIPPSILVTTLPTPNASSMTTSETTYPNSPTGPGTNSTTEITYPTTMTETSSTATSLPPTSPLVSTAKTAKTPTTNLVTTTTKTTSHSTTSFTSSTVYSTASTYTTAITSVPTTLGTMVTSTSMISSTVSTGIPTSQPTTITPSSVGISGSLPMMTDLTSVYTVSNMSARPTTVIPSSPTVQNTEISISVSMTSATTPSGGPTFTSTENTPTRSLLTSFPMTHSFSSSMSESSAGTTHTESISSPRGTTSTLHTTVESTPSPTTTTSFTTSTMMEPPSSTVSTTGRGQTTFPSSTATFPETTTLTPTTDISTVSLTTAMTSPPPVSSSITPTNTMTSMRTTTYWPTATNTLSPLTSSILSSTPVPSTEMITSHTTNTTPLSTLVTTLLTTITRSTPTSETTYPTSPTSIVSDSTTEITYSTSITGTLSTATTLPPTSSSLPTTETATMTPTTTLITTTPNTTSLSTPSFTSSTIYSTVSTSTTAISSASPTSGTMVTSTTMTPSSLSTDTPSTTPTTITYPSVGSTGFLTTATDLTSTFTVSSSSAMSTSVIPSSPSIQNTETSSLVSMTSATTPSLRPTITSTDSTLTSSLLTTFPSTYSFSSSMSASSAGTTHTETISSLPASTNTIHTTAESALAPTTTTSFTTSPTMEPPSTTVATTGTGQTTFPSSTATFLETTTLTPTTDFSTESLTTAMTSTPPITSSITPTDTMTSMRTTTSWPTATNTLSPLTSSILSSTPVPSTEVTTSHTTNTNPVSTLVTTLPITITRSTLTSETAYPSSPTSTVTESTTEITYPTTMTETSSTATSLPPTSSLVSTAETAKTPTTNLVTTTTKTTSHSTTSFTSSTIYSTASTPTTAITSVPTTLGTMVTSTSMIPSTVSTGIPTSQPTTITPSSVGISGSLPMMTDLTSVYTVSSMSARPTSVIPSSPTVQNTETSIFVSMMSATTPSGGPTFTSTENTPTRSLLTSFPVTHSFSSSMSASSVGTTHTQSISSPPAITSTLHTTAESTPSPTTTMSFTTFTKMETPSSTVATTGTGQTTFTSSTATSPKTTTLTPTSDISTGSFKTAVSSTPPITSSITSTYTVTSMTTTTPLGPTATNTLPSFTSSVSSSTPVPSTEAITSGTTNTTPLSTLVTTFSNSDTSSTPTSETTYPTSLTSALTDSTTRTTYSTNMTGTLSTVTSLRPTSSSLLTTVTATVPTTNLVTTTTKITSHSTPSFTSSIATTETPSHSTPRFTSSITTTETPSHSTPRFTSSITNTKTTSHSSPSFTSSITTTETTSHNTPSLTSSITTTKTTSHSTPSYTSLITTTTTTSHSTPSFTSSITTTETTSHNTPSLTSSITTTETTSHSTPSFTSSITTETTSHSTPSFTSLITITEITSHSTLSYTTSITTTETPSHSTLSFTSSITTTETTSHSTPSFTSSITTSEMPSHSTPSFTSSITTTENATHSTPNFTSSITTTETTSHSTPSFTSLITTTETTSHRWGTTETTSYSTPSFTSSNTITETTSHSTPSYITSITTTETPSSSTPSFSSSITTTETTSHSTPGFTSSITTTETTSHSTPSFTSSITTTETTSHDTPSFTSSITTSETPSHSTPSSTSLITTTKTTSHSTPSFTSSITTTETTSHSAHSFTSSITTTETTSHNTRSFTSSITTTETNSHSTTSFTSSITTTETTSHSTPSFSSSITTTETPLHSTPGLTSWVTTTKTTSHITPGLTSSITTTETTSHSTPGFTSSITTTETTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRA

SEQ ID NO: 1649 - protein, 1119 aa, synthetic construct
  REGION 1..1119: note = MUC3B (Q9H195) ECD
TLSTATSTSHVTFPRAEATRTALSNSPHSRYLAEWPQGVPQLASPAPGHRENAPMTLTTSPHDTLISETLLSSLVSSNTSTTPTSKFAFKVETTPPTVLVYSATTECVYPTSFIITISHSTSICVTTTQVTFTSSYTPTPVTQKPVTTVTRTYPMTTTEKGTSAMISSPSTTTARETPIVTVTPSSSVSATDTTFHTTISSTTRTTERTPLPTGSIHTTMSPTPVFTTLKTAVTSTSPITSTITSTNTVTSMTTTTSRPTATNTLSSLTSSILSSTPAPNTEVITSHTTTTTPPSTLVTTLPTAIARSTPTSETTPSFMSSIITTETTSHSTPSFSSSTIHSTVSSSTTAITSPFTTAETGVTSTPSSPSSLSTDIPTTSLRTLTPLSLSTSTSLTTTTDLPSIPTDISSLPTPIHIISSSPSIQSTETSSLVGTTSPTMSTVRATLRSTENTPISSFSTSIVVTPETPTTQAPPVLMSATGTQTSPVPTTVTFGSMDSSTSTLHTLTPSTALSKIMSTSQFPIPSTHSSTLQTTPSIPSLQTSLTSTSEFTTESFTRGSTSTNAILTSFSTIIWSSTPTIIMSSSPSSASITPVFATTIHSVPSSPYIFSTENVGSASITAFPSLSSSSTTSTSPTSSSLTTALTEITPFSYISLPSTTPCPGTITITIVPASPTDPCVEMDPSTEATSPPTTPLTVFPFTTEMVTCPSSISMQTTLATHMDTSSMTPESESSIIPNASSSTGTGTVPTNTVFTSTRLPTSETWLSNNSVIPTPLPGVSTIPLTMKPSSSLPTILRTSSKSTHPSPPTARTSQTSVATTQTPTTLTTCRTTPITSWMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDANSCQDSQALCFKPDSIKVNNNSKTELTPEAICRRAAPTGYEEFYFPLVEATRLRCVTKCTSGLDNAIDCHQGQCVLETSGPACRCYSTDTHWFSGPRCEVTVHWRA

SEQ ID NO: 1650 - protein, 2097 aa, synthetic construct
  REGION 1..2097: note = MUC4 (Q99102) ECD
TTEDTLITGSKTAAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDA

SEQ ID NO: 1651 - protein, 472 aa, synthetic construct
  REGION 1..472: note = MUSK (O15146) ECD
LPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAEWSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLDYNKENLKTFPPMTSSKPSVDIPNLPSSSSSSFSVSPTYSMT

SEQ ID NO: 1652 - protein, 322 aa, synthetic construct
  REGION 1..322: note = MXRA8 (Q9BRK3) ECD
VLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQ

SEQ ID NO: 1653 - protein, 399 aa, synthetic construct
  REGION 1..399: note = NAGPA (Q9UK23) ECD
DCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHCQDNMWRCPRQVSTVVCVHEPRCQPPDCHGHGTCVDGHCQCTGHFWRGPGCDELDCGPSNCSQHGLCTETGCRCDAGWTGSNCSEECPLGWHGPGCQRPCKCEHHCPCDPKTGNCSVSRVKQCLQPPEATLRAGELSFFTRT

SEQ ID NO: 1654 - protein, 699 aa, synthetic construct
  REGION 1..699: note = NCAM1 (P13591) ECD
LQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSG

SEQ ID NO: 1655 - protein, 678 aa, synthetic construct
  REGION 1..678: note = NCAM2 (O15394) ECD
LLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFN

SEQ ID NO: 1656 - protein, 237 aa, synthetic construct
  REGION 1..237: note = NCR1 (O76036) ECD
QQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLR

SEQ ID NO: 1657 - protein, 171 aa, synthetic construct
  REGION 1..171: note = NCR2 (O95944) ECD
QSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTSWTPRDLVSSQTQTQSCVPPTAGARQAPESPSTIPVPSQPQNSTLRPGPAAPIA

SEQ ID NO: 1658 - protein, 117 aa, synthetic construct
  REGION 1..117: note = NCR3 (O14931) ECD
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 1659 - protein, 238 aa, synthetic construct
  REGION 1..238: note = NCR3LG1 (Q68D85) ECD
DLKVEMMAGGTQITPLNDNVTIFCNIFYSQPLNITSMGITWFWKSLTFDKEVKVFEFFGDHQEAFRPGAIVSPWRLKSGDASLRLPGIQLEEAGEYRCEVVVTPLKAQGTVQLEVVASPASRLLLDQVGMKENEDKYMCESSGFYPEAINITWEKQTQKFPHPIEISEDVITGPTIKNMDGTFNVTSCLKLNSSQEDPGTVYQCVVRHASLHTPLRSNFTLTAARHSLSETEKTDNFS

SEQ ID NO: 1660 - protein, 636 aa, synthetic construct
  REGION 1..636: note = NCSTN (Q92542) ECD
NSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELE

SEQ ID NO: 1661 - protein, 1072 aa, synthetic construct
  REGION 1..1072: note = NEO1 (Q92859) ECD
ARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKADSSDKMPNDQASGSGGKGSRLPDLGSDYKPPMSGSNSPHGSPTSPLDSNML

SEQ ID NO: 1662 - protein, 322 aa, synthetic construct
  REGION 1..322: note = NETO1 (Q8TDF5) ECD
TKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPDPDFKDLGALKPLPACEFEMGGSEGIVESIQIMKEGKATASEAVDCKWYIRAPPRSKIYLRFLDYEMQNSNECKRNFVAVYDGSSSVEDLKAKFCSTVANDVMLRTGLGVIRMWADEGSRNSRFQMLFTSFQEPPCEGNTFFCHSNMCINNTLVCNGLQNCVYPWDENHCKEKRKTSLLDQLTNTSGT

SEQ ID NO: 1663 - protein, 325 aa, synthetic construct
  REGION 1..325: note = NETO2 (Q8NC67) ECD
IAVAQKTQDGQNIGIKHIPATQCGIWVRTSNGGHFASPNYPDSYPPNKECIYILEAAPRQRIELTFDEHYYIEPSFECRFDHLEVRDGPFGFSPLIDRYCGVKSPPLIRSTGRFMWIKFSSDEELEGLGFRAKYSFIPDPDFTYLGGILNPIPDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEPPCTSSTFFCHSNMCINNSLVCNGVQNCAYPWDENHCKEKKKAGVFEQITKTH

SEQ ID NO: 1664 - protein, 121 aa, synthetic construct
  REGION 1..121: note = NFAM1 (Q8NET5) ECD
QSVTHTGLPIMASLANTAISFSCRITYPYTPQFKVFTVSYFHEDLQGQRSPKKPTNCHPGLGTENQSHTLDCQVTLVLPGASATGTYYCSVHWPHSTVRGSGTFILVRDAGYREPPQSPQK

SEQ ID NO: 1665 - protein, 1193 aa, synthetic construct
  REGION 1..1193: note = NFASC (O94856) ECD
IEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAPPTLPPTTVGATGAVSSTDATAIAATTEATTVPIIPTVAPTTIATTTTVATTTTTTAAATTTTESPPTTTSGTKIHESAPDEQSIWNVTVLPNSKWANITWKHNFGPGTDFVVEYIDSNHTKKTVPVKAQAQPIQLTDLYPGMTYTLRVYSRDNEGISSTVITFMTSTAYTNNQADIATQGW

SEQ ID NO: 1666 - protein, 222 aa, synthetic construct
  REGION 1..222: note = NGFR (P08138) ECD
KEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDN

SEQ ID NO: 1667 - protein, 672 aa, synthetic construct
  REGION 1..672: note = NLGN1 (Q8N2Q7) ECD
QKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDVKRISKECARKPGKKICRKGGPLTKKQTDDLGDNDGAEDEDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELS

SEQ ID NO: 1668 - protein, 663 aa, synthetic construct
  REGION 1..663: note = NLGN2 (Q8NFZ4) ECD
QRGGGGPGGGAPGGPGLGLGSLGEERFPVVNTAYGRVRGVRRELNNEILGPVVQFLGVPYATPPLGARRFQPPEAPASWPGVRNATTLPPACPQNLHGALPAIMLPVWFTDNLEAAATYVQNQSEDCLYLNLYVPTEDGPLTKKRDEATLNPPDTDIRDPGKKPVMLFLHGGSYMEGTGNMFDGSVLAAYGNVIVATLNYRLGVLGFLSTGDQAAKGNYGLLDQIQALRWLSENIAHFGGDPERITIFGSGAGASCVNLLILSHHSEGLFQKAIAQSGTAISSWSVNYQPLKYTRLLAAKVGCDREDSAEAVECLRRKPSRELVDQDVQPARYHIAFGPVVDGDVVPDDPEILMQQGEFLNYDMLIGVNQGEGLKFVEDSAESEDGVSASAFDFTVSNFVDNLYGYPEGKDVLRETIKFMYTDWADRDNGEMRRKTLLALFTDHQWVAPAVATAKLHADYQSPVYFYTFYHHCQAEGRPEWADAAHGDELPYVFGVPMVGATDLFPCNFSKNDVMLSAVVMTYWTNFAKTGDPNQPVPQDTKFIHTKPNRFEEVVWSKFNSKEKQYLHIGLKPRVRDNYRANKVAFWLELVPHLHNLHTELFTTTTRLPPYATRWPPRPPAGAPGTRRPPPPATLPPEPEPEPGPRAYDRFPGDSRDYSTELS

SEQ ID NO: 1669 - protein, 672 aa, synthetic construct
  REGION 1..672: note = NLGN3 (Q9NZ94) ECD
QAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDVKRISKECARKPNKKICRKGGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELS

SEQ ID NO: 1670 - protein, 635 aa, synthetic construct
  REGION 1..635: note = NLGN4X (Q8N0W4) ECD
QAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELS

SEQ ID NO: 1671 - protein, 633 aa, synthetic construct
  REGION 1..633: note = NLGN4Y (Q8NFZ3) ECD
QYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDDIHEQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELS

SEQ ID NO: 1672 - protein, 1717 aa, synthetic construct
  REGION 1..1717: note = NOTCH1 (P46531) ECD
ARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLH

SEQ ID NO: 1673 - protein, 1652 aa, synthetic construct
  REGION 1..1652: note = NOTCH2 (Q04721) ECD
LQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQ

SEQ ID NO: 1674 - protein, 1604 aa, synthetic construct
  REGION 1..1604: note = NOTCH3 (Q9UM47) ECD
APPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPL

SEQ ID NO: 1675 - protein, 1424 aa, synthetic construct
  REGION 1..1424: note = NOTCH4 (Q99466) ECD
RGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPW

SEQ ID NO: 1676 - protein, 1033 aa, synthetic construct
  REGION 1..1033: note = NPHS1 (O60500) ECD
QLAIPASVPRGFWALPENLTVVEGASVELRCGVSTPGSAVQWAKDGLLLGPDPRIPGFPRYRLEGDPARGEFHLHIEACDLSDDAEYECQVGRSEMGPELVSPRVILSILVPPKLLLLTPEAGTMVTWVAGQEYVVNCVSGDAKPAPDITILLSGQTISDISANVNEGSQQKLFTVEATARVTPRSSDNRQLLVCEASSPALEAPIKASFTVNVLFPPGPPVIEWPGLDEGHVRAGQSLELPCVARGGNPLATLQWLKNGQPVSTAWGTEHTQAVARSVLVMTVRPEDHGAQLSCEAHNSVSAGTQEHGITLQVTFPPSAIIILGSASQTENKNVTLSCVSKSSRPRVLLRWWLGWRQLLPMEETVMDGLHGGHISMSNLTFLARREDNGLTLTCEAFSEAFTKETFKKSLILNVKYPAQKLWIEGPPEGQKLRAGTRVRLVCLAIGGNPEPSLMWYKDSRTVTESRLPQESRRVHLGSVEKSGSTFSRELVLVTGPSDNQAKFTCKAGQLSASTQLAVQFPPTNVTILANASALRPGDALNLTCVSVSSNPPVNLSWDKEGERLEGVAAPPRRAPFKGSAAARSVLLQVSSRDHGQRVTCRAHSAELRETVSSFYRLNVLYRPEFLGEQVLVVTAVEQGEALLPVSVSANPAPEAFNWTFRGYRLSPAGGPRHRILSSGALHLWNVTRADDGLYQLHCQNSEGTAEARLRLDVHYAPTIRALQDPTEVNVGGSVDIVCTVDANPILPGMFNWERLGEDEEDQSLDDMEKISRGPTGRLRIHHAKLAQAGAYQCIVDNGVAPPARRLLRLVVRFAPQVEHPTPLTKVAAAGDSTSSATLHCRARGVPNIVFTWTKNGVPLDLQDPRYTEHTYHQGGVHSSLLTIANVSAAQDYALFTCTATNALGSDQTNIQLVSISRPDPPSGLKVVSLTPHSVGLEWKPGFDGGLPQRFCIRYEALGTPGFHYVDVVPPQATTFTLTGLQPSTRYRVWLLASNALGDSGLADKGTQLPITTPGLHQPSGEPEDQLPTEPPS

SEQ ID NO: 1677 - protein, 441 aa, synthetic construct
  REGION 1..441: note = NPR1 (P16066) ECD
GNLTVAVVLPLANTSYPWSWARVGPAVELALAQVKARPDLLPGWTVRTVLGSSENALGVCSDTAAPLAAVDLKWEHNPAVFLGPGCVYAAAPVGRFTAHWRVPLLTAGAPALGFGVKDEYALTTRAGPSYAKLGDFVAALHRRLGWERQALMLYAYRPGDEEHCFFLVEGLFMRVRDRLNITVDHLEFAEDDLSHYTRLLRTMPRKGRVIYICSSPDAFRTLMLLALEAGLCGEDYVFFHLDIFGQSLQGGQGPAPRRPWERGDGQDVSARQAFQAAKIITYKDPDNPEYLEFLKQLKHLAYEQFNFTMEDGLVNTIPASFHDGLLLYIQAVTETLAHGGTVTDGENITQRMWNRSFQGVTGYLKIDSSGDRETDFSLWDMDPENGAFRVVLNYNGTSQELVAVSGRKLNWPLGYPPPDIPKCGFDNEDPACNQDHLSTLE

SEQ ID NO: 1678 - protein, 436 aa, synthetic construct
  REGION 1..436: note = NPR2 (P20594) ECD
RNLTLAVVLPEHNLSYAWAWPRVGPAVALAVEALGRALPVDLRFVSSELEGACSEYLAPLSAVDLKLYHDPDLLLGPGCVYPAASVARFASHWRLPLLTAGAVASGFSAKNDHYRTLVRTGPSAPKLGEFVVTLHGHFNWTARAALLYLDARTDDRPHYFTIEGVFEALQGSNLSVQHQVYAREPGGPEQATHFIRANGRIVYICGPLEMLHEILLQAQRENLTNGDYVFFYLDVFGESLRAGPTRATGRPWQDNRTREQAQALREAFQTVLVITYREPPNPEYQEFQNRLLIRAREDFGVELGPSLMNLIAGCFYDGILLYAEVLNETIQEGGTREDGLRIVEKMQGRRYHGVTGLVVMDKNNDRETDFVLWAMGDLDSGDFQPAAHYSGAEKQIWWTGRPIPWVKGAPPSDNPPCAFDLDDPSCDKTPLSTLAI

SEQ ID NO: 1679 - protein, 455 aa, synthetic construct
  REGION 1..455: note = NPR3 (P17342) ECD
GGVGGGGGGAGIGGGRQEREALPPQKIEVLVLLPQDDSYLFSLTRVRPAIEYALRSVEGNGTGRRLLPPGTRFQVAYEDSDCGNRALFSLVDRVAAARGAKPDLILGPVCEYAAAPVARLASHWDLPMLSAGALAAGFQHKDSEYSHLTRVAPAYAKMGEMMLALFRHHHWSRAALVYSDDKLERNCYFTLEGVHEVFQEEGLHTSIYSFDETKDLDLEDIVRNIQASERVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSSGGLEE

SEQ ID NO: 1680 - protein, 311 aa, synthetic construct
  REGION 1..311: note = NPTN (Q9Y639) ECD
QNAGFVKSPMSETKLTGDAFELYCDVVGSPTPEIQWWYAEVNRAESFRQLWDGARKRRVTVNTAYGSNGVSVLRITRLTLEDSGTYECRASNDPKRNDLRQNPSITWIRAQATISVLQKPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAP

SEQ ID NO: 1681 - protein, 1143 aa, synthetic construct
  REGION 1..1143: note = NRCAM (Q92823) ECD
QMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQ

SEQ ID NO: 1682 - protein, 835 aa, synthetic construct
  REGION 1..835: note = NRP1 (O14786) ECD
FRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDP

SEQ ID NO: 1683 - protein, 844 aa, synthetic construct
  REGION 1..844: note = NRP2 (O60462) ECD
RGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKVDIPEIHEREGYEDEIDDEYEVDWSNSSSATSGSGAPSTDKEKSWLYTLDP

SEQ ID NO: 1684 - protein, 632 aa, synthetic construct
  REGION 1..632: note = NRROS (Q86YC3) ECD
WRNRSGTATAASQGVCKLVGGAADCRGQSLASVPSSLPPHARMLTLDANPLKTLWNHSLQPYPLLESLSLHSCHLERISRGAFQEQGHLRSLVLGDNCLSENYEETAAALHALPGLRRLDLSGNALTEDMAALMLQNLSSLRSVSLAGNTIMRLDDSVFEGLERLRELDLQRNYIFEIEGGAFDGLAELRHLNLAFNNLPCIVDFGLTRLRVLNVSYNVLEWFLATGGEAAFELETLDLSHNQLLFFPLLPQYSKLRTLLLRDNNMGFYRDLYNTSSPREMVAQFLLVDGNVTNITTVSLWEEFSSSDLADLRFLDMSQNQFQYLPDGFLRKMPSLSHLNLHQNCLMTLHIREHEPPGALTELDLSHNQLSELHLAPGLASCLGSLRLFNLSSNQLLGVPPGLFANARNITTLDMSHNQISLCPLPAASDRVGPPSCVDFRNMASLRSLSLEGCGLGALPDCPFQGTSLTYLDLSSNWGVLNGSLAPLQDVAPMLQVLSLRNMGLHSSFMALDFSGFGNLRDLDLSGNCLTTFPRFGGSLALETLDLRRNSLTALPQKAVSEQLSRGLRTIYLSQNPYDCCGVDGWGALQHGQTVADWAMVTCNLSSKIIRVTELPGGVPRDCKWERLDLGL

SEQ ID NO: 1685 - protein, 346 aa, synthetic construct
  REGION 1..346: note = NRXN1 (P58400) ECD
ASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTT

SEQ ID NO: 1686 - protein, 1371 aa, synthetic construct
  REGION 1..1371: note = NRXN1 (Q9ULB1) ECD
LEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTT

SEQ ID NO: 1687 - protein, 540 aa, synthetic construct
  REGION 1..540: note = NRXN2 (P58401) ECD
ARVSSSLSTTHHVHHFHSKHGTVPIAINRMPFLTRGGHAGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTT

SEQ ID NO: 1688 - protein, 1608 aa, synthetic construct
  REGION 1..1608: note = NRXN2 (Q9P2S2) ECD
LEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVNKLHYLVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTT

SEQ ID NO: 1689 - protein, 527 aa, synthetic construct
  REGION 1..527: note = NRXN3 (Q9HDB5) ECD
SSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTT

SEQ ID NO: 1690 - protein, 1541 aa, synthetic construct
  REGION 1..1541: note = NRXN3 (Q9Y4C0) ECD
LEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEDVSQDPGLSHLMMSEQAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTTGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTT

SEQ ID NO: 1691 - protein, 391 aa, synthetic construct
  REGION 1..391: note = NTRK1 (P04629) ECD
AAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVG

SEQ ID NO: 1692 - protein, 399 aa, synthetic construct
  REGION 1..399: note = NTRK2 (Q16620) ECD
CPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREH

SEQ ID NO: 1693 - protein, 398 aa, synthetic construct
  REGION 1..398: note = NTRK3 (Q16288) ECD
CPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDT

SEQ ID NO: 1694 - protein, 1782 aa, synthetic construct
  REGION 1..1782: note = NUP210 (Q8TEM1) ECD
KLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSSKLKARIQEAVYKNVRPAEVRLLILENILLNPAYDVYLMVGTSIHYKVQKIRQGKITELSMPSDQYELQLQNSIPGPEGDPARPVAVLAQDTSMVTALQLGQSSLVLGHRSIRMQGASRLPNSTIYVVEPGYLGFTVHPGDRWVLETGRLYEITIEVFDKFSNKVYVSDNIRIETVLPAEFFEVLSSSQNGSYHRIRALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGIRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLAPVYTSPQLDMSCPLLQQNKQVVPVSSHRNPRLDLAAYDQEGRRFDNFSSLSIQWESTRPVLASIEPELPMQLVSQDDESGQKKLHGLQAILVHEASGTTAITATATGYQESHLSSARTKQPHDPLVPLSASIELILVEDVRVSPEEVTIYNHPGIQAELRIREGSGYFFLNTSTADVVKVAYQEARGVAMVHPLLPGSSTIMIHDLCLVFPAPAKAVVYVSDIQELYIRVVDKVEIGKTVKAYVRVLDLHKKPFLAKYFPFMDLKLRAASPIITLVALDEALDNYTITFLIRGVAIGQTSLTASVTNKAGQRINSAPQQIEVFPPFRLMPRKVTLLIGATMQVTSEGGPQPQSNILFSISNESVALVSAAGLVQGLAIGNGTVSGLVQAVDAETGKVVIISQDLVQVEVLLLRAVRIRAPIMRMRTGTQMPIYVTGITNHQNPFSFGNAVPGLTFHWSVTKRDVLDLRGRHHEASIRLPSQYNFAMNVLGRVKGRTGLRVVVKAVDPTSGQLYGLARELSDEIQVQVFEKLQLLNPEIEAEQILMSPNSYIKLQTNRDGAASLSYRVLDGPEKVPVVHVDEKGFLASGSMIGTSTIEVIAQEPFGANQTIIVAVKVSPVSYLRVSMSPVLHTQNKEALVAVPLGMTVTFTVHFHDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVLDPAAGSQGPLSTTLTFSSPVTNQAIAIPVTVAFVVDRRGPGPYGASLFQHFLDSYQ

SEQ ID NO: 1695 - protein, 1777 aa, synthetic construct
  REGION 1..1777: note = NUP210L (Q5VU65) ECD
ANKLNVPQVLLPFGREPGRVPFLLEAQRGCYTWHSTHHDAVTVEPLYENGTLCSQKAVLIAESTQPIRLSSIILAREIVTDHELRCDVKVDVINSIEIVSRARELYVDDSPLELMVRALDAEGNTFSSLAGMMFEWSIAQDNESAREELSSKIRILKYSEAEYAPPIYIAEMEKEEKQGDVILVSGIRTGAAVVKVRIHEPFYKKVAAALIRLLVLENIFLIPSHDIYLLVGTYIKYQVAKMVQGRVTEVKFPLEHYILELQDHRVALNGSHSEKVAILDDKTAMVTASQLGQTNLVFVHKNVHMRSVSGLPNCTIYVVEPGFLGFTVQPGNRWSLEVGQVYVITVDVFDKSSTKVYISDNLRITYDFPKEYFEEQLTTVNGSYHIVKALKDGVVVINASLTSIIYQNKDIQPIKFLIKHQQEVKIYFPIMLTPKFLAFPHHPMGMLYRYKVQVEGGSGNFTWTSSNETVVIVTTKGVVTAGQVRGNSTVLARDVQNPFRYGEIKIHVLKLNKMELLPFHADVEIGQIIEIPIAMYHINKETKEAMAFTDCSHLSLDLNMDKQGVFTLLKEGIQRPGPMHCSSTHIAAKSLGHTLVTVSVNECDKYLESSATFAAYEPLKALNPVEVALVTWQSVKEMVFEGGPRPWILEPSRFFLELNAEKTEKIGIAQVWLPSKRKQNQYIYRIQCLDLGEQVLTFRIGNHPGVLNPSPAVEVLQVRFICAHPASMSVTPVYKVPAGAQPCPLPQHNKWLIPVSRLRDTVLELAVFDQHRRKFDNFSSLMLEWKSSNETLAHFEDYKSVEMVAKDDGSGQTRLHGHQILKVHQIKGTVLIGVNFVGYSEKKSPKEISNLPRSVDVELLLVDDVTVVPENATIYNHPDVKETFSLVEGSGYFLVNSSEQGVVTITYMEAESSVELVPLHPGFFTLEVYDLCLAFLGPATAHLRVSDIQELELDLIDKVEIDKTVLVTVRVLGSSKRPFQNKYFRNMELKLQLASAIVTLTPMEQQDEYSENYILRATTIGQTTLVAIAKDKMGRKYTSTPRHIEVFPPFRLLPEKMTLIPMNMMQVMSEGGPQPQSIVHFSISNQTVAVVNRRGQVTGKIVGTAVVHGTIQTVNEDTGKVIVFSQDEVQIEVVQLRAVRILAAATRLITATKMPVYVMGVTSTQTPFSFSNANPGLTFHWSMSKRDVLDLVPRHSEVFLQLPVEHNFAMVVHTKAAGRTSIKVTVHCMNSSSGQFEGNLLELSDEVQILVFEKLQLFYPECQPEQILMPINSQLKLHTNREGAAFVSSRVLKCFPNSSVIEEDGEGLLKAGSIAGTAVLEVTSIEPFGVNQTTITGVQVAPVTYLRVSSQPKLYTAQGRTLSAFPLGMSLTFTVQFYNSIGEKFHTHNTQLYLALNRDDLLHIGPGNKNYTYMAQAVNRGLTLVGLWDRRHPGMADYIPVAVEHAIEPDTKLTFVGDIICFSTHLVSQHGEPGIWMISANNILQTDIVTGVGVARSPGTAMIFHDIPGVVKTYREVVVNASSRLMLSYDLKTYLTNTLNSTVFKLFITTGRNGVNLKGFCTPNQALAITKVLLPATLMLCHVQFSNTLLDIPASKVFQVHSDFSMEKGVYVCIIKVRPQSEELLQALSVADTSVYGWATLVSERSKNGMQRILIPFIPAFYINQSELVLSHKQDIGEIRVLGVDRVLRKLEVISSSPVLVVAGHSHSPLTPGLAIYSVRVVNFTSFQQMASPVFINISCVLTSQSEAVVVRAMKDKLGADHCEDSAILKRFTGSYQ

SEQ ID NO: 1696 - protein, 713 aa, synthetic construct
  REGION 1..713: note = OSMR (Q99650) ECD
ERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRVYLMNPFSVNFENVNATNAIMTWKVHSIRNNFTYLCQIELHGEGKMMQYNVSIKVNGEYFLSELEPATEYMARVRCADASHFWKWSEWSGQNFTTLEAAPSEAPDVWRIVSLEPGNHTVTLFWKPLSKLHANGKILFYNVVVENLDKPSSSELHSIPAPANSTKLILDRCSYQICVIANNSVGASPASVIVISADPENKEVEEERIAGTEGGFSLSWKPQPGDVIGYVVDWCDHTQDVLGDFQWKNVGPNTTSTVISTDAFRPGVRYDFRIYGLSTKRIACLLEKKTGYSQELAPSDNPHVLVDTLTSHSFTLSWKDYSTESQPGFIQGYHVYLKSKARQCHPRFEKAVLSDGSECCKYKIDNPEEKALIVDNLKPESFYEFFITPFTSAGEGPSATFTKVTTPDEHSSM

SEQ ID NO: 1697 - protein, 253 aa, synthetic construct
  REGION 1..253: note = OSTM1 (Q86WC4) ECD
ALPFGSSPHRVFHDLLSEQQLLEVEDLSLSLLQGGGLGPLSLPPDLPDLDPECRELLLDFANSSAELTGCLVRSARPVRLCQTCYPLFQQVVSKMDNISRAAGNTSESQSCARSLLMADRMQIVVILSEFFNTTWQEANCANCLTNNSEELSNSTVYFLNLFNHTLTCFEHNLQGNAHSLLQTKNYSEVCKNCREAYKTLSSLYSEMQKMNELENKAEPGTHLCIDVEDAMNITRKLWSRTFNCSVPCSDTVP

SEQ ID NO: 1698 - protein, 833 aa, synthetic construct
  REGION 1..833: note = PAM (P19021) ECD
FKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSG

SEQ ID NO: 1699 - protein, 238 aa, synthetic construct
  REGION 1..238: note = PARM1 (Q6UWI2) ECD
LPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGS

SEQ ID NO: 1700 - protein, 795 aa, synthetic construct [sequence omitted]

SEQ ID NO: 1701 - protein, 697 aa, synthetic construct
  REGION 1..697: note = PCDH10 (Q9P2E7) ECD
QLHYTVQEEQEHGTFVGNIAEDLGLDITKLSARGFQTVPNSRTPYLDLNLETGVLYVNEKIDREQICKQSPSCVLHLEVFLENPLELFQVEIEVLDINDNPPSFPEPDLTVEISESATPGTRFPLESAFDPDVGTNSLRDYEITPNSYFSLDVQTQGDGNRFAELVLEKPLDREQQAVHRYVLTAVDGGGGGGVGEGGGGGGGAGLPPQQQRTGTALLTIRVLDSNDNVPAFDQPVYTVSLPENSPPGTLVIQLNATDPDEGQNGEVVYSFSSHISPRARELFGLSPRTGRLEVSGELDYEESPVYQVYVQAKDLGPNAVPAHCKVLVRVLDANDNAPEISFSTVKEAVSEGAAPGTVVALFSVTDRDSEENGQVQCELLGDVPFRLKSSFKNYYTIVTEAPLDREAGDSYTLTVVARDRGEPALSTSKSIQVQVSDVNDNAPRFSQPVYDVYVTENNVPGAYIYAVSATDRDEGANAQLAYSILECQIQGMSVFTYVSINSENGYLYALRSFDYEQLKDFSFQVEARDAGSPQALAGNATVNILIVDQNDNAPAIVAPLPGRNGTPAREVLPRSAEPGYLLTRVAAVDADDGENARLTYSIVRGNEMNLFRMDWRTGELRTARRVPAKRDPQRPYELVIEVRDHGQPPLSSTATLVVQLVDGAVEPQGGGGSGGGGSGEHQRPSRSGGGETSLDLT

SEQ ID NO: 1702 - protein, 789 aa, synthetic construct
  REGION 1..789: note = PCDH11X (Q9BZA7) ECD
QEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVK

SEQ ID NO: 1703 - protein, 816 aa, synthetic construct
  REGION 1..816: note = PCDH11Y (Q9BZA8) ECD
TNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVK

SEQ ID NO: 1704 - protein, 694 aa, synthetic construct
  REGION 1..694: note = PCDH12 (Q9NPG4) ECD
QEVTTLTVKYQVSEEVPSGTVIGKLSQELGREERRRQAGAAFQVLQLPQALPIQVDSEEGLLSTGRRLDREQLCRQWDPCLVSFDVLATGDLALIHVEIQVLDINDHQPRFPKGEQELEISESASLRTRIPLDRALDPDTGPNTLHTYTLSPSEHFALDVIVGPDETKHAELIVVKELDREIHSFFDLVLTAYDNGNPPKSGTSLVKVNVLDSNDNSPAFAESSLALEIQEDAAPGTLLIKLTATDPDQGPNGEVEFFLSKHMPPEVLDTFSIDAKTGQVILRRPLDYEKNPAYEVDVQARDLGPNPIPAHCKVLIKVLDVNDNIPSIHVTWASQPSLVSEALPKDSFIALVMADDLDSGHNGLVHCWLSQELGHFRLKRTNGNTYMLLTNATLDREQWPKYTLTLLAQDQGLQPLSAKKQLSIQISDINDNAPVFEKSRYEVSTRENNLPSLHLITIKAHDADLGINGKVSYRIQDSPVAHLVAIDSNTGEVTAQRSLNYEEMAGFEFQVIAEDSGQPMLASSVSVWVSLLDANDNAPEVVQPVLSDGKASLSVLVNASTGHLLVPIETPNGLGPAGTDTPPLATHSSRPFLLTTIVARDADSGANGEPLYSIRSGNEAHLFILNPHTGQLFVNVTNASSLIGSEWELEIVVEDQGSPPLQTRALLRVMFVTSVDHLRDSARKPGALSMSMLT

SEQ ID NO: 1705 - protein, 1350 aa, synthetic construct
  REGION 1..1350: note = PCDH15 (Q96QU1) ECD
QYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGA

SEQ ID NO: 1706 - protein, 690 aa, synthetic construct
  REGION 1..690: note = PCDH17 (O14917) ECD
LKNLNYSVPEEQGAGTVIGNIGRDARLQPGLPPAERGGGGRSKSGSYRVLENSAPHLLDVDADSGLLYTKQRIDRESLCRHNAKCQLSLEVFANDKEICMIKVEIQDINDNAPSFSSDQIEMDISENAAPGTRFPLTSAHDPDAGENGLRTYLLTRDDHGLFGLDVKSRGDGTKFPELVIQKALDREQQNHHTLVLTALDGGEPPRSATVQINVKVIDSNDNSPVFEAPSYLVELPENAPLGTVVIDLNATDADEGPNGEVLYSFSSYVPDRVRELFSIDPKTGLIRVKGNLDYEENGMLEIDVQARDLGPNPIPAHCKVTVKLIDRNDNAPSIGFVSVRQGALSEAAPPGTVIALVRVTDRDSGKNGQLQCRVLGGGGTGGGGGLGGPGGSVPFKLEENYDNFYTVVTDRPLDRETQDEYNVTIVARDGGSPPLNSTKSFAIKILDENDNPPRFTKGLYVLQVHENNIPGEYLGSVLAQDPDLGQNGTVSYSILPSHIGDVSIYTYVSVNPTNGAIYALRSFNFEQTKAFEFKVLAKDSGAPAHLESNATVRVTVLDVNDNAPVIVLPTLQNDTAELQVPRNAGLGYLVSTVRALDSDFGESGRLTYEIVDGNDDHLFEIDPSSGEIRTLHPFWEDVTPVVELVVKVTDHGKPTLSAVAKLIIRSVSGSLPEGVPRVNGEQHHWDMSLP

SEQ ID NO: 1707 - protein, 672 aa, synthetic construct
  REGION 1..672: note = PCDH18 (Q9HCL0) ECD
KNLKYRIYEEQRVGSVIARLSEDVADVLLKLPNPSTVRFRAMQRGNSPLLVVNEDNGEISIGATIDREQLCQKNLNCSIEFDVITLPTEHLQLFHIEVEVLDINDNSPQFSRSLIPIEISESAAVGTRIPLDSAFDPDVGENSLHTYSLSANDFFNIEVRTRTDGAKYAELIVVRELDRELKSSYELQLTASDMGVPQRSGSSILKISISDSNDNSPAFEQQSYIIQLLENSPVGTLLLDLNATDPDEGANGKIVYSFSSHVSPKIMETFKIDSERGHLTLFKQVDYEITKSYEIDVQAQDLGPNSIPAHCKIIIKVVDVNDNKPEININLMSPGKEEISYIFEGDPIDTFVALVRVQDKDSGLNGEIVCKLHGHGHFKLQKTYENNYLILTNATLDREKRSEYSLTVIAEDRGTPSLSTVKHFTVQINDINDNPPHFQRSRYEFVISENNSPGAYITTVTATDPDLGENGQVTYTILESFILGSSITTYVTIDPSNGAIYALRIFDHEEVSQITFVVEARDGGSPKQLVSNTTVVLTIIDENDNVPVVIGPALRNNTAEITIPKGAESGFHVTRIRAIDRDSGVNAELSCAIVAGNEENIFIIDPRSCDIHTNVSMDSVPYTEWELSVIIQDKGNPQLHTKVLLKCMIFEYAESVTSTAMTSVSQASLDVS

SEQ ID NO: 1708 - protein, 657 aa, synthetic construct
  REGION 1..657: note = PCDH19 (Q8TAB3) ECD
LINLKYSVEEEQRAGTVIANVAKDAREAGFALDPRQASAFRVVSNSAPHLVDINPSSGLLVTKQKIDRDLLCRQSPKCIISLEVMSSSMEICVIKVEIKDLNDNAPSFPAAQIELEISEAASPGTRIPLDSAYDPDSGSFGVQTYELTPNELFGLEIKTRGDGSRFAELVVEKSLDRETQSHYSFRITALDGGDPPRLGTVGLSIKVTDSNDNNPVFSESTYAVSVPENSPPNTPVIRLNASDPDEGTNGQVVYSFYGYVNDRTRELFQIDPHSGLVTVTGALDYEEGHVYELDVQAKDLGPNSIPAHCKVTVSVLDTNDNPPVINLLSVNSELVEVSESAPPGYVIALVRVSDRDSGLNGRVQCRLLGNVPFRLQEYESFSTILVDGRLDREQHDQYNLTIQARDGGVPMLQSAKSFTVLITDENDNHPHFSKPYYQVIVQENNTPGAYLLSVSARDPDLGLNGSVSYQIVPSQVRDMPVFTYVSINPNSGDIYALRSFNHEQTKAFEFKVLAKDGGLPSLQSNATVRVIILDVNDNTPVITAPPLINGTAEVYIPRNSGIGYLVTVVKAEDYDEGENGRVTYDMTEGDRGFFEIDQVNGEVRTTRTFGESSKSSYELIVVAHDHGKTSLSASALVLIYLSPALDAQESMGSVNLS

SEQ ID NO: 1709 - protein, 830 aa, synthetic construct
  REGION 1..830: note = PCDH20 (Q8N6Y1) ECD
SYSRATELLYSLNEGLPAGVLIGSLAEDLRLLPRSAGRPDPQSQLPERTGAEWNPPLSFSLASRGLSGQYVTLDNRSGELHTSAQEIDREALCVEGGGGTAWSGSVSISSSPSDSCLLLLDVLVLPQEYFRFVKVKIAIRDINDNAPQFPVSQISVWVPENAPVNTRLAIEHPAVDPDVGINGVQTYRLLDYHGMFTLDVEENENGERTPYLIVMGALDRETQDQYVSIIIAEDGGSPPLLGSATLTIGISDINDNCPLFTDSQINVTVYGNATVGTPIAAVQAVDKDLGTNAQITYSYSQKVPQASKDLFHLDENTGVIKLFSKIGGSVLESHKLTILANGPGCIPAVITALVSIIKVIFRPPEIVPRYIANEIDGVVYLKELEPVNTPIAFFTIRDPEGKYKVNCYLDGEGPFRLSPYKPYNNEYLLETTKPMDYELQQFYEVAVVAWNSEGFHVKRVIKVQLLDDNDNAPIFLQPLIELTIEENNSPNAFLTKLYATDADSEERGQVSYFLGPDAPSYFSLDSVTGILTVSTQLDREEKEKYRYTVRAVDCGKPPRESVATVALTVLDKNDNSPRFINKDFSFFVPENFPGYGEIGVISVTDADAGRNGWVALSVVNQSDIFVIDTGKGMLRAKVSLDREQQSSYTLWVEAVDGGEPALSSTAKITILLLDINDNPPLVLFPQSNMSYLLVLPSTLPGSPVTEVYAVDKDTGMNAVIAYSIIGRRGPRPESFRIDPKTGNITLEEALLQTDYGLHRLLVKVSDHGYPEPLHSTVMVNLFVNDTVSNESYIESLLRKEPEINIEEKEPQISIEPTHRKVESVSCMPTL

SEQ ID NO: 1710 - protein, 851 aa, synthetic construct
  REGION 1..851: note = PCDH7 (O60245) ECD
AAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLS

SEQ ID NO: 1711 - protein, 720 aa, synthetic construct
  REGION 1..720: note = PCDH8 (O95206) ECD
KTVRYSTFEEDAPGTVIGTLAEDLHMKVSGDTSFRLMKQFNSSLLRVREGDGQLTVGDAGLDRERLCGQAPQCVLAFDVVSFSQEQFRLVHVEVEVRDVNDHAPRFPRAQIPVEVSEGAAVGTRIPLEVPVDEDVGANGLQTVRLAEPHSPFRVELQTRADGAQCADLVLLQELDRESQAAYSLELVAQDGGRPPRSATAALSVRVLDANDHSPAFPQGAVAEVELAEDAPVGSLLLDLDAADPDEGPNGDVVFAFGARTPPEARRLFRLDPRSGRLTLAGPVDYERQDTYELDVRAQDRGPGPRAATCKVIVRIRDVNDNAPDIAITPLAAPGAPATSPFAAAAAAAALGGADASSPAGAGTPEAGATSLVPEGAARESLVALVSTSDRDSGANGQVRCALYGHEHFRLQPAYAGSYLVVTAASLDRERIAEYNLTLVAEDRGAPPLRTVRPYTVRVGDENDNAPLFTRPVYEVSVRENNPPGAYLATVAARDRDLGRNGQVTYRLLEAEVGRAGGAVSTYVSVDPATGAIYALRSFDYETLRQLDVRIQASDGGSPQLSSSALVQVRVLDQNDHAPVLVHPAPANGSLEVAVPGRTAKDTVVARVQARDADEGANGELAFELQQQEPREAFAIGRRTGEILLTGDLSQEPPGRVFRALLVISDGGRPPLTTTATVSFVVTAGGGRGPAAPASAGSPERSRPPGSRLGVSGSVLQWDTP

SEQ ID NO: 1712 - protein, 791 aa, synthetic construct
  REGION 1..791: note = PCDH9 (Q9HC56) ECD
QELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLT

SEQ ID NO: 1713 - protein, 668 aa, synthetic construct
  REGION 1..668: note = PCDHA1 (Q9Y5I3) ECD
QLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVN

SEQ ID NO: 1714 - protein, 667 aa, synthetic construct
  REGION 1..667: note = PCDHA10 (Q9Y5I2) ECD
QLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQVSARDGGVPPLGSNLTLQVFVLDENDNAPALLASPAGSAGGAVSELVLRSVVAGHVVAKVRAVDADSGYNAWLSYELQSAAVGARIPFRVGLYTGEISTTRALDETDSPRQRLLVLVKDHGEPSLTATATVLVSLVEGSQAPKASSRASVGVAPEVALVDVN

SEQ ID NO: 1715 - protein, 667 aa, synthetic construct
  REGION 1..667: note = PCDHA11 (Q9Y5I1) ECD
QLHYSVSEEAKHGTFVGRIAQDLGLELAELVQRLFRVASKTHGDLLEVNLQNGILFVNSRIDREELCGQSAECSIHLEVIVDRPLQVFHVNVEVKDINDNPPVFSLREQKLLIAESKQSDSRFPLEGASDADIEENALLTYRLSKNEYFSLDSPTNGKQIKRLSLILKKSLDREKTPELNLLLTATDGGKPELTGTVRLLVQVLDVNDNDPEFDKSEYKVSLMENAAKETLVLKLNATDRDEGVNGEVTYSLMSIKPNGRHLFTLDQNNGEVRVNGTLDYEENKFYKIEVQATDKGTPPMAGHCTVWVEILDTNDNSPEVAVTSLSLPVREDAQPSTVIALISVSDRDSGVNGQVTCSLTPHVPFKLVSTFKNYYSLVLDSALDRENVWAYELVVTARDGGSPSLWATARVSVEVADVNDNAPAFAQPEYTVFVKENNPPGCHIFTVSARDADAQENALVSYSLVERRLGDRALSSYVSVHAESGKVYALQPLDHEELELLQFQVSARDAGVPPLSSNVTLQVFVLDENDNAPALLATQAGSAGGAVNKLVPRSVGAGHVVAKVRAVDADSGYNAWLSYELQPAAGGSRIPFRVGLYTGEISTTRALDEADSPRHRLLVLVKDHGEPALTATATVLVSLVESGQAPKASSRTLAGAASPEAALVDVN

SEQ ID NO: 1716 - protein, 668 aa, synthetic construct
  REGION 1..668: note = PCDHA12 (Q9UN75) ECD
QLHYSVYEEAKHGTFVGRIAQDLGLELAELVPRLFRVASKRHGDLLEVNLQNGILFVNSRIDREKLCGRSAECSIHLEVIVDRPLQVFHVDVEVKDINDNPPVFREREQKVPVSESAPLDSHFPLEGASDADIGVNSLLTYALSLNENFELKIKTKKDKSILPELVLRKLLDREQTPKLNLLLMVIDGGKPELTGSVQIQITVLDVNDNGPAFDKPSYKVVLSENVQNDTRVIQLNASDPDEGLNGEISYGIKMILPVSEKCMFSINPDTGEIRIYGELDFEENNAYEIQVNAIDKGIPSMAGHSMVLVEVLDVNDNVPEVMVTSLSLPVQEDAQVGTVIALISVSDRDSGANGQVICSLTPHVPFKLVSTYKNYYSLVLDSALDRESVSAYELVVTARDGGSPSLWATARVSVEVADVNDNAPAFAQPEYTVFVKENNPPGCHIFTVSAWDADAQKNALVSYSLVERRVGEHALSSYVSVHAESGKVYALQPLDHEELELLQFQVSARDAGVPPLGSNVTLQVFVLDENDNAPALLATPAGSAGGAVSELVPRSVGAGHVVAKVRAVDADSGYNAWLSYELQPAAVGAHIPFHVGLYTGEISTTRILDEADAPRHRLLVLVKDHGEPALTSTATVLVSLVENGQAPKTSSRASVGAVDPEAALVDIN

SEQ ID NO: 1717 - protein, 668 aa, synthetic construct
  REGION 1..668: note = PCDHA13 (Q9Y5I0) ECD
QLHYSVPEEAKHGTFVGRIAQDLGLELAELVPRLFRVASKRHGDLLEVNLQNGILFVNSRIDREELCGRSAECSIHLEVIVDRPLQVFHVEVKVRDINDNPPIFPESKKRIIIAESRPPETRFPLDGASDADIGVNSALTYRLDPNDYFTLDAQNSLEQMSSLSLVLRKTLDREEIQEHSLLLTASDGGKPELTGTVQLLITILDVNDNAPEFYQSVYKVTVLENAFNGTLVIKLNATDPDDGTNGDIVYSFRRPVWPAVVYAFTINPNNGEIRTKGKLDFEEKKLYEISVEAVDKGNIPMAGHCTLLVEVLDVNDNAPEVTITSLSLPIREDTQPSAIIALISVSDRDSGSNGQVTCTLTPHVPFKLVSTYKNYYSLVLDSALDRESVSAYELVVTARDGGSPSLWATASVSVGVADVNDNAPAFAQPEYTVFVKENNPPGCHIFTVSAQDADAQENALVSYSLVERRVGERALSSYVSVHAESGKVYALQPLDHEELELLQFQVSARDSGVPPLGSNVTLQVFVLDENDNAPALLTPGAGSAGGTVSELMPRSVGAGHVVAKVRAVDADSGYNAWLSYELQLAAVGARIPFRVGLYTGEISTTRPLDEVDAPHHRLLVLVKDHGEPALTATATVLLSLVESGQAPQASSRASAGAVGPEAALVDVN

SEQ ID NO: 1718 - protein, 675 aa, synthetic construct
  REGION 1..675: note = PCDHA2 (Q9Y5H9) ECD
AWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVN

SEQ ID NO: 1719 - protein, 668 aa, synthetic construct
  REGION 1..668: note = PCDHA3 (Q9Y5H8) ECD
QLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVN

SEQ ID NO: 1720 - protein, 668 aa, synthetic construct
  REGION 1..668: note = PCDHA4 (Q9UN74) ECD
QLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVN

SEQ ID NO: 1721 - protein, 668 aa, synthetic construct
  REGION 1..668: note = PCDHA5 (Q9Y5H7) ECD
QLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVN

SEQ ID NO: 1722 - protein, 668 aa, synthetic construct
  REGION 1..668: note = PCDHA6 (Q9UN73) ECD
QLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQVSARDAGVPPLGSNVTLQVFVLDENDNAPALLAPRVGGTGGAVSELVPRSLGAGQVVAKVRAVDADSGYNAWLSYELQPPASSARFPFRVGLYTGEISTTRVLDEADSPRHRLLVLVKDHGEPALTATATVLVSLVESGQAPKASSRASVGAAGPEAALVDVN

SEQ ID NO: 1723 - protein, 668 aa, synthetic construct
  REGION 1..668: note = PCDHA7 (Q9UN72) ECD
QLHYSVPEEAKHGNFVGRIAQDLGLELAELVPRLFRAVCKFRGDLLEVNLQNGILFVNSRIDREELCGRSAECSIHLEVIVERPLQVFHVDVEVKDINDNPPVFPATQRNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTVLVEVVDVNDNAPQLTLTSLSLPIPEDAQPGTVITLISVFDRDFGVNGQVTCSLTPRVPFKLVSTFKNYYSLVLDSALDRESVSAYELVVTARDGGSPSLWATASVSVEVADVNDNAPAFAQPEYTVFVKENNPPGCHIFTVSAGDADAQKNALVSYSLVELRVGERALSSYVSVHAESGKVYALQPLDHEELELLQFQVSARDAGVPPLGSNVTLQVFVLDENDNAPALLAPRVGGTGGAVRELVPRSVGAGHVVAKVRAVDADSGYNAWLSYELQPVAAGASIPFRVGLYTGEISTTRALDETDAPRHRLLVLVKDHGEPSLTATATVLVSLVESGQAPKASSRASLGIAGPETELVDVN

SEQ ID NO: 1724 - protein, 668 aa, synthetic construct
  REGION 1..668: note = PCDHA8 (Q9Y5H6) ECD
QLHYSVPEEAKHGTFVGRIAQDLGLELAELVPRLFRVASKRHRDLLEVSLQNGILFVNSRIDREELCGRSAECSIHLEVIVDRPLQVFHVDVEVKDVNDNPPVFRVKDQKLFVSESRMPDSRFPLEGASDADVGANSVLTYRLSSHDYFMLDVNSKNDENKLVELVLRKSLDREDAPAHHLFLTATDGGKPELTGTVQLLVTVLDVNDNAPTFEQSEYEVRIFENADNGTTVIKLNASDPDEGANGAISYSFNSLVETMVIDHFSIDRNTGEIVIRGNLDFEQENLYKILIDATDKGHPPMAGHCTVLVRILDKNDNVPEIALTSLSLPVREDAQFGTVIALISVNDLDSGANGQVTCSLMPHVPFKLVSTFKNYYSLVLDSALDRERVSAYELVVTARDGGSPSLWATASLSVEVADVNDNAPAFAQPEYTVFVKENNPPGCHIFTVSARDADAQENALVSYSLVERRVGERSLSSYISVHTESGKVYALQPLDHEELELLQFQVSARDAGVPPLGSNVTLQVFVLDENDNAPALLEPRVGGTGGAASKLVPRSVGAGHVVAKVRAVDADSGYNAWLSYELQPAASSPRIPFRVGLYTGEISTTRVLDEADSPRHRLLVLVKDHGEPALTATATVLVSLVESGQAPKASSRQSAGVLGPEAALVDVN

SEQ ID NO: 1725 - protein, 668 aa, synthetic construct
  REGION 1..668: note = PCDHA9 (Q9Y5H5) ECD
QLHYSVPEEAEHGTFVGRIAQDLGLELAELVPRLFQLDSKGRGDLLEVNLQNGILFVNSRIDREELCGRSAECSIHLEVIVDRPLQVFHVDVEVKDINDNPPVFPATQKNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTLLVEVVDVNDNAPQLTIKTLSVPVKEDAQLGTVIALISVIDLDADANGQVTCSLTPHVPFKLVSTYKNYYSLVLDRALDRESVSAYELVVTARDGGSPSLWATARVSVEVADVNDNAPAFAQSEYTVFVKENNPPGCHIFTVSARDADAQENALVSYSLVERRLGERSLSSYVSVHAESGKVYALQPLDHEELELLQFQVSARDAGVPPLGSNVTLQVFVLDENDNAPALLTPRMRGTDGAVSEMVLRSVGAGVVVGKVRAVDADSGYNAWLSYELQPETASASIPFRVGLYTGEISTTRALDETDAPRQRLLVLVKDHGEPALTATATVLVSLVESGQAPKSSSRASVGATGPEVTLVDVN

SEQ ID NO: 1726 - protein, 665 aa, synthetic construct
  REGION 1..665: note = PCDHAC1 (Q9H158) ECD
AGQLEYSVPEETERGVAVGNLSADLRLPAAAMSSRNFRFLSSHRELYFGVDLPSGNLVVREPADREQLCRAKAACVLTYDLVLEDPLELHKIRIHVLDTNDNSPLFPAGDVQLHIPEFLTPGARFTLPNAQDDDEGSNGILSYSLSPSQHFRLDMGSRVDGSEYPELVLEKALDREQRATHLLVLTARDGGLPARSGDAQVTIIVVDTNDNAPVFERSVYRTKVPETAPNGTVLFRVQALDPDEGSNGEVQYSLSNSTQAELRHRFHVHPKSGEVQVAASLGPPETLLEAYIEARDEGVFGLASTAKLLVEVTDVNDHAPELDFLTLSNPVPEDAAPGTVIALFSVKDEDLDSNGRVICGMSSAGPFQLTASFDNYYSLLIDGPLDREQISEYQVLITASDSGSPPLSTRRTITVSVADVNDNTPNFPQPQQELFVAENNGPGASLGRVFAQDPDLGKNGLVSYELLDVISEGPSASSLLAVESSSGAITAKTSFDFEQLRGFHFQVEGRDGGIPPRSATVTINLFVVDRNDNYPVILFPLPRNGSVPVEIVPRSARTGHLVTKVVAEDADSGSNAWLSYHISRASDSSLFRISANIGELRTARLVLPTDAVKQRVVVVVRDHGDPPLSSSVTLGVLLSNSVPQLLPDFEDVWEPGGQLSAQNLY

SEQ ID NO: 1727 - protein, 666 aa, synthetic construct
  REGION 1..666: note = PCDHAC2 (Q9Y5I4) ECD
QLRYSVPEEQAPGALVGNVARALGLELRRLGPGCLRINHLGAPSPRYLELDLTSGALFVNERIDREALCEQRPRCLLSLEVLAHNPVAVSAVEVEILDINDNSPRFPRPNYQLQVSESVAPGARFHIESAQDPDVGANSVQTYELSPSEHFELDLKPLQENSKVLELVLRKGLDREQAALHHLVLTAVDGGIPARSGTAQISVRVLDTNDNSPAFDQSTYRVQLREDSPPGTLVVKLNASDPDEGSNGELRYSLSSYTSDRERQLFSIDASTGEVRVIGGLDYEEASSYQIYVQATDRGPVPMAGHCKVLVDIVDVNDNAPEVVLTDLYSPVPENATPNTIVAVLSVNDQDSGPNRKVSLGLEATLPFRLNGFGNSYTLVVSGPLDRERVAVYNITVTATDGGIPQLTSLRTLKVEISDINDNPPSFLEDSYSIYIQENNLPGVLLCTVQATDPDEKENAEVTYSLLEREIQGLPVTSYVSINSASGSLYAVNSFDYEKFREFFVTVEAQDKGSPPLSSTVTANVYVVDMNDHAPHILYPTSTNSSAAFEMVPRTAPAGYLVTKVIAMDSDSGQNAWLFYHLAQTSDLDLFKVELHTGEIRTTRKMGDESGSTFNLTVVVRDNGEPSLSASVAITVAVVDRVSKILPDTQRHVKSPRTYSEITLYL

SEQ ID NO: 1728 - protein, 663 aa, synthetic construct
  REGION 1..663: note = PCDHB1 (Q9Y5F3) ECD
TTIRYSVAEEMESGSFVANVAKDLGLEVGKLAARGARLVSEGNKMHFRLHRKTGDLFVKEKLDRESLCGKADPCVLHFEVVLVEPLQSFRAEVRVFDINDNAPVFLNKEPLLKIPESTPLGSRFPLQSAQDLDVGLNGLQNYTLSANGYFHLHTRFCSHGPKYAELVLNKPLDREEQPEVNLTITAVDGGSPPKSGTAHIHVVVLDVNDHVPQFSRLVYRAQVSENSPNGSLVATVTAVDLDEGTNKAITYSLAQNPEAILKTFQIDPQNGEVRLRGPLDFEAIETYDIDIQATDGGGLSAHSKVLVEVVDVNDNPPEVMVSSVSSPLPEDSPPQTVVALFTIRDRDIRVGGKVTCFLREDLPFVIKPTFGNSYSLVTDRSLDREEVSGYNITIVAMDTGPPSLSAETMIEVLISDVNDNPPIFREDSYILTVRENNSPAVFIGKVHAEDLDLGENAQITYSLLPPKNGDLSVFAYISINSGNGKLYALRTMDYEAIQDFQFVVKATDGGFLSLSSQVTVRVVVLDDNDNRPMILYPLQNGTLPCNDLVPRSAEAGYLVTKVVAVDGDSGQNSWLSYHLLKATDLGLFSVQRQNGEIHTLRQISERDPMMQKLIILVQDHGQPALSTTVSLNILLVDGFSEPYLQFQDPTKHSRKVNPSTKYL

SEQ ID NO: 1729 - protein, 666 aa, synthetic construct
  REGION 1..666: note = PCDHB10 (Q9UN67) ECD
GSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHAPVFQDKETVLKISENTAEGTAFRLERAQDPDGGLNGIQNYTISPNSFFHINISGGDEGMIYPELVLDKALDREEQGELSLTLTALDGGSPSRSGTSTVRIVVLDVNDNAPQFAQALYETQAPENSPIGFLIVKVWAEDVDSGVNAEVSYSFFDASENIRTTFQINPFSGEIFLRELLDYELVNSYKINIQAMDGGGLSARCRVLVEVLDTNDNPPELIVSSFSNSVAENSPETPLAVFKINDRDSGENGKMVCYIQENLPFLLKPSVENFYILITEGALDREIRAEYNITITVTDLGTPRLKTEHNITVLVSDVNDNAPAFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHLLLVDGFSQPYLPLPEAAPAQAQAEADLLTVYL

SEQ ID NO: 1730 - protein, 664 aa, synthetic construct
  REGION 1..664: note = PCDHB11 (Q9Y5F2) ECD
GSETWSFSVAEEMQSGSFVGNLAKDLGLKVRELSSRGARVVSNDKKQRLQLDINTGDLLLSETLDREELCGSIEPCVLHLQVLMQNPTQFLQIELQVRDINDHSPIFSEKQMLLEIPENSPVGAVFLLESAKDLDVGINAVKSYTISPNSHFHIKMRVIPDNRKYPELVLDKALDYEELPELSFILSALDGGSPPRSGTALVRVVVVDINDNSPEFEQAFYEVKIRENSILGSLILIVSAWDLDSGTNGEICYTFSHASEDIRKTFEINQKSGEITLRAPLDFETIESYSIIIQATDGGGLFGKSTVIIHVIDVNDNAPEITVSSITSPIPENTPETVVMVFSIQDIDSGDNGRIVCSIPEDLPFVLKSSVENYYTLETERPLDRESTAEYNITITVTDLGIPRLKTEHNTTVLVSDVNDNAPTFTQTSYTLFVRENNSPALHIGSVSATDRDSGTNAQVNYSLLPPQDLHLPLASLVSINTDNGHLFALRSLDYEALQAFDFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLQVLLVDGFSQPYLPLPEAAPAQAQADSLTVYL

SEQ ID NO: 1731 - protein, 664 aa, synthetic construct
  REGION 1..664: note = PCDHB12 (Q9Y5F1) ECD
GSETGNFLVMEELQSGSFVGNLAKTLGLEVSELSSRGARVVSNDNKECLQLDTNTGDLLLREMLDREELCGSNEPCVLYFQVLMKNPTQFLQIELQVRDINDHSPVFLEKEMLLEIPENSPVGAVFLLESAKDLDVGINAVKSYTINPNSHFHVKIRVNPDNRKYPELVLDKALDYEERPELSFILTALDGGSPPRSGTALVRVVVVDINDNSPEFEQAFYEVKILENSILGSLVVTVSAWDLDSGTNSELSYTFSHASEDIRKTFEINQKSGDITLTAPLDFEAIESYSIIIQATDGGGLFGKSTVRIQVMDVNDNAPEITVSSITSPIPENTPETVVMVFRIRDRDSGDNGKMVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYL

SEQ ID NO: 1732 - protein, 662 aa, synthetic construct
  REGION 1..662: note = PCDHB13 (Q9Y5F0) ECD
AEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPQDPHLPLTSLVSINADNGHLFALRSLDYEALQGFQFRVGASDHGSPALSSEALVRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYL

SEQ ID NO: 1733 - protein, 660 aa, synthetic construct
  REGION 1..660: note = PCDHB14 (Q9Y5E9) ECD
GTESAHYSVAEETEIGSFVANLARDLGLGVEELSSREARVVSDDNKKYLHLDLLTGNLLLNEKLDRDELCGSTEPCVLHFQVVLENPLQFFRFELCVKDINDHSPTFLDKEILIKISEGTTVGATFLMESAQDLDVGSNSLQNYTISPNSHFYIKIPDSSDRKIYPELVLDRALDYEQEAELRLTLTAVDGGSPPKSGTTLVLIKVLDINDNAPEFPQSLYEVQVPEDRPLGSWIATISAKDLDAGNYGKISYTFFHASEDIRKTFEINPISGEVNLRSPLDFEVIQSYTINIQATDGGGLSGKCTLLVKVMDINDNPPEVTISSITKRIPENASETLVALFSILDQDSGDNGRMICSIQDNLPFFLKPTFKNFFTLVSEKALDRESQAEYNITITVTDLGTPRLKTEYNITVLLSDVNDNAPTFTQTSYTLFVRENNSPALHIGSVSATDRDSGTNAQVNYSLLPPQDRHLPLASLVSINADNGHLFALRSLDYEALQEFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSL

SEQ ID NO: 1734 - protein, 664 aa, synthetic construct
  REGION 1..664: note = PCDHB15 (Q9Y5E8) ECD
GWEPRRYSVMEETERGSFVANLANDLGLGVGELAERGARVVSEDNEQGLQLDLQTGQLILNEKLDREKLCGPTEPCIMHFQVLLKKPLEVFRAELLVTDINDHSPEFPEREMTLKIPETSSLGTVFPLKKARDLDVGSNNVQNYNISPNSHFHVSTRTRGDGRKYPELVLDTELDREEQAELRLTLTAVDGGSPPRSGTVQILILVLDANDNAPEFVQALYEVQVPENSPVGSLVVKVSARDLDTGTNGEISYSLYYSSQEIDKPFELSSLSGEIRLIKKLDFETMSSYDLDIEASDGGGLSGKCSVSVKVLDVNDNFPELSISSLTSPIPENSPETEVALFRIRDRDSGENGKMICSIQDDVPFKLKPSVENFYRLVTEGALDRETRAEYNITITITDLGTPRLKTEQSITVLVSDVNDNAPAFTQTSYTLFVRENNSPALHIGSVSATDRDSGTNAQVTYSLLPPRDPHLPLTSLVSINTDNGHLFALQSLDYEALQAFEFRVGATDRGFPALSSEALVRVLVLDANDNSPFVLYPLQNGSAPCTELVPRAAEPGYLVTKVVAVDGDSGQNAWLSYQLLKATEPGLFGVWAHNGEVRTARLLSERDVAKHRLVVLVKDNGEPPRSATATLQVLLVDGFSQPYLPLPEAAPAQAQADSLTVYL

SEQ ID NO: 1735 - protein, 662 aa, synthetic construct
  REGION 1..662: note = PCDHB16 (Q9NRJ7) ECD
ELGSYSVVEETERGSFVANLGKDLGLGLTEMSTRKARIISQGNKQHLQLKAQTGDLLINEKLDREELCGPTEPCILHFQVLMENPLEIFQAELRVIDINDHSPMFTEKEMILKIPENSPLGTEFPLNHALDLDVGSNNVQNYKISPSSHFRVLIHEFRDGRKYPELVLDKELDREEEPQLRLTLTALDGGSPPRSGTAQVRIEVVDINDNAPEFEQPIYKVQIPENSPLGSLVATVSARDLDGGANGKISYTLFQPSEDISKTLEVNPMTGEVRLRKQVDFEMVTSYEVRIKATDGGGLSGKCTLLLQVVDVNDNPPQVTMSALTSPIPENSPEIVVAVFSVSDPDSGNNGKTISSIQEDLPFLLKPSVKNFYTLVTERALDREARAEYNITLTVTDMGTPRLKTEHNITVQISDVNDNAPTFTQTSYTLFVRENNSPALHIGSVSATDRDSGTNAQVTYSLLPPQDPHLPLASLVSINADNGHLFALRSLDYEALREFEFRVSATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPRSATATLHVLLVDGFSQPFLPLPEAAPGQTQANSLTVYL

SEQ ID NO: 1736 - protein, 662 aa, synthetic construct
  REGION 1..662: note = PCDHB2 (Q9Y5E7) ECD
QPRHYSVAEETESGSFVANLLKDLGLEIGELAVRGARVVSKGKKMHLQFDRQTGDLLLNEKLDREELCGPTEPCVLPFQVLLENPLQFFQAELRIRDVNDHSPVFLDKEILLKIPESITPGTTFLIERAQDLDVGTNSLQNYTISPNFHFHLNLQDSLDGIILPQLVLNRALDREEQPEIRLTLTALDGGSPPRSGTALVRIEVVDINDNVPEFAKLLYEVQIPEDSPVGSQVAIVSARDLDIGTNGEISYAFSQASEDIRKTFRLSAKSGELLLRQKLDFESIQTYTVNIQATDGGGLSGTCVVFVQVMDLNDNPPELTMSTLINQIPENLQDTLIAVFSVSDPDSGDNGRMVCSIQDDLPFFLKPSVENFYTLVISTALDRETRSEYNITITVTDFGTPRLKTEHNITVLVSDVNDNAPAFTQTSYTLFVRENNSPALHIGSVSATDRDSGTNAQVTYSLLPPQDPHLPLASLVSINADNGHLFALQSLDYEALQAFEFRVGAADRGSPALSSEALVRVLVLDANDNSPFVLYPLQNGSAPCTELVPRAAEPGYLVTKVVAVDGDSGQNAWLSYQLLKATEPGLFGVWAHNGEVRTARLLRERDAAKQRLVVLVKDNGEPPRSATATLHVLLVDGFSQPYLLLPEAAPAQAQADLLTVYL

SEQ ID NO: 1737 - protein, 664 aa, synthetic construct
  REGION 1..664: note = PCDHB3 (Q9Y5E6) ECD
GSESRRYSVAEEKEKGFLIANLAKDLGLRVEELAARGAQVVSKGNKQHFQLSHQTGDLLLNEKLDREELCGPTEPCILHFQILLQNPLQFVTNELRIIDVNDHSPVFFENEMHLKILESTLPGTVIPLGNAEDLDVGRNSLQNYTITPNSHFHVLTRSRRDGRKYPELVLDKALDPEEQPELSLTLTALDGGSPPRSGTAQINIQVLDINDNAPEFAQPLYEVAVLENTPVNSVIVTVSASDLDTGSFGTISYAFFHASEEIRKTFQLNPITGDMQLVKYLNFEAINSYEVDIEAKDGGGLSGKSTVIVQVVDVNDNPPELTLSSVNSPIPENSGETVLAVFSVSDLDSGDNGRVMCSIENNLPFFLKPSVENFYTLVSEGALDRETRSEYNITITITDLGTPRLKTKYNITVLVSDVNDNAPAFTQISYTLFVRENNSPALHIGSVSATDRDSGTNAQVTYSLLPPQDPHLPLSSLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYL

SEQ ID NO: 1738 - protein, 662 aa, synthetic construct
  REGION 1..662: note = PCDHB4 (Q9Y5E5) ECD
EPIRYSVLEETESGSFVAHLAKDLGLGIGELASRSARVLSDDDKQRLQLDRQTGDLLLREKLDREELCGPIEPCVLHFQVFLEMPVQFFQGELLIQDINDHSPIFPEREVLLKILENSQPGTLFPLLIAEDLDVGSNGLQKYTISPNSHFHILTRNHSEGKKYPDLVQDKPLDREEQPEFSLTLVALDGGSPPRSGTVMVRILIMDINDNAPEFVHTPYGVQVLENSPLDSPIVRVLARDIDAGNFGSVSYGLFQASDEIKQTFSINEVTGEILLKKKLDFEKIKSYHVEIEATDGGGLSGKGTVVIEVVDVNDNPPELIISSLTSSIPENAPETVVSIFRIRDRDSGENGKMICSIPDNLPFILKPTLKNFYTLVTERPLDRETSAEYNITIAVTDLGTPRLKTQQNITVQVSDVNDNAPAFTQTSYTLFVRENNSPALHIGSVSATDRDSGTNAQVTYSLLPPQDPHLPLASLVSINADNGHLFALRSLDYEALQAFEFRVGASDRGSPALSSEALVRVLVLDTNDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYL

SEQ ID NO: 1739 - protein, 659 aa, synthetic construct
  REGION 1..659: note = PCDHB5 (Q9Y5E4) ECD
VRYSIPEETESGYSVANLAKDLGLGVGELATRGARMHYKGNKELLQLDIKTGNLLLYEKLDREVMCGATEPCILHFQLLLENPVQFFQTDLQLTDINDHAPEFPEKEMLLKIPESTQPGTVFPLKIAQDFDIGSNTVQNYTISPNSHFHVATHNRGDGRKYPELVLDKALDREERPELSLTLTALDGGAPPRSGTTTIRIVVLDNNDNAPEFLQSFYEVQVPENSPLNSLVVVVSARDLDAGAYGSVAYALFQGDEVTQPFVIDEKTAEIRLKRALDFEATPYYNVEIVATDGGGLSGKCTVAIEVVDVNDNAPELTMSTLSSPTPENAPETVVAVFSVSDPDSGDNGRMICSIQNDLPFLLKPTLKNFYTLVTQRTLDRESQAEYNITITVTDMGTPRLKTEHNITVLVSDVNDNAPAFTQTSYTLFVRENNSPALHIGSVSATDRDSGTNAQVTYSLLPPQNPHLRLASLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFSMWAHNGEVRTARLLSERDAAKHRLVVLVKDNGEPPRSATATLHVLLVDGFSQPYLPLPEAAPAQAQADSLTVYL

SEQ ID NO: 1740 - protein, 661 aa, synthetic construct
  REGION 1..661: note = PCDHB6 (Q9Y5E3) ECD
ESIQYSVLEETESGTFVANLTKDLGLRVGELASRGARVVFKGNRQHLQFDPQTHDLLLNEKLDREELCGSTEPCVLPFQVLLENPLQFFQASLRVRDINDHAPEFPAREMLLKISEITMPGKIFPLKMAHDLDTGSNGLQRYTISSNPHFHVLTRNRSEGRKFPELVLDKPLDREEQPQLRLTLIALDGGSPPRSGTSEIQIQVLDINDNVPEFAQELYEAQVPENNPLGSLVITVSARDLDAGSFGKVSYALFQVDDVNQPFEINAITGEIRLRKALDFEEIQSYDVDVEATDGGGLSGKCSLVVRVLDVNDNAPELTMSFFISLIPENLPEITVAVFSVSDADSGHNQQVICSIENNLPFLLRPSVENFYTLVTEGALDRESRAEYNITITVTDLGTPRLKTQQSITVQVSDVNDNVPAFTQTSYTLFVRENNSPALHIGSVSATDRDSGINAQVTYSLLPPQDPHLPLSSLVSINADNGHLFALRSLDYEALQSFEFRVGATDRGSPALSSEALVRLLVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPAQAQADSLTVYL

SEQ ID NO: 1741 - protein, 662 aa, synthetic construct
  REGION 1..662: note = PCDHB7 (Q9Y5E2) ECD
GAEPLRYFVAEETERGTFLTNLAKDLGLGVGELRARGTRIVSDQNMQILLLSSLTGDLLLNEKLDREELCGPREPCVLPFQLLLEKPFQIFRAELWVRDINDHAPVFLDREISLKILESTTPGAAFLLESAQDSDVGTNSLSNYTISPNAYFHINVHDSGEGNIYPELVLNQVLDREEIPEFSLTLTALDGGSPPRSGTALVRILVLDVNDNAPDFVRSLYKVQVPENSPVGSMVVSVSARDLDTGSNGEIAYAFSYATERILKTFQINPTSGSLHLKAQLDYEAIQTYTLTIQAKDGGGLSGKCTVVVDVTDINDNRPELLLSSLTSPIAENSPETVVAVFRIRDRDSGNNGKTVCSIQDDVPFILKPSVENFYTLVTEKPLDRERNTEYNITITVTDLGTPRLKTEHNITVLVSDVNDNAPAFTQTSYTLFVRENNSPALPIGSVSATDRDSGTNAQVIYSLLPSQDPHLPLASLVSINADNGHLFALRSLDYEALQAFEFRVGATDRGSPALSSEALVRVLVLDANDNSPFVLYPLQNSSAPCTEPLPRAAEPGYLVTKVVAVDGDSGQNAWLSYQLLKATEPGLFGVWAHNGEVRTARLLSERDAAKQRLVVLVKDNGEPPRSATATLHVLLVDGFSQPYLRLPEAAPDQANSLTVYL

SEQ ID NO: 1742 - protein, 662 aa, synthetic construct
  REGION 1..662: note = PCDHB8 (Q9UN66) ECD
EPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTAFPLKNAEDLDIGQNNIENYIISPNSYFRVLTRKRSDGRKYPELVLDKALDREEEAELRLTLTALDGGSPPRSGTAQVYIEVVDVNDNAPEFEQPFYRVQISEDSPISFLVVKVSATDVDTGVNGEISYSLFQASDEISKTFKVDFLTGEIRLKKQLDFEKFQSYEVNIEARDAGGFSGKCTVLIQVIDVNDHAPEVTMSAFTSPIPENAPETVVALFSVSDLDSGENGKISCSIQEDLPFLLKSSVGNFYTLLTETPLDRESRAEYNVTITVTDLGTPRLTTHLNMTVLVSDVNDNAPAFTQTSYTLFVRENNSPALHIGSVSATDRDSGTNAQVTYSLLPPQDPHLPLASLVSINTDNGHLFALRSLDYEALQAFEFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPCSATATLHVLLVDGFSQPYLPLPEAAPAQGQADSLTVYL

SEQ ID NO: 1743 - protein, 664 aa, synthetic construct
  REGION 1..664: note = PCDHB9 (Q9Y5E1) ECD
GSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHSPVFRHKEMVLKISENTAEGTAFRLERAQDPDEGHNSIQNYTISSNSFFHIKISGSDEGMIYPELVLDKALDREEQEELSLTLTALDGGSPSRSGTSTIRIVVLDVNDNAPQFAQALYETQAPENSPVGSLIVKVSAGDADSGVNAEVSYSFFDASEDILTTFQINPFSGEIFLRELLDYELVNSYKINIQAMDGGGLSARCTVLIKVLDSNDNPPELIISSLSNSVAENSPGIVLAVFKIKDRDSGENGKTICYVQDNLPFFLKPSVDNFYILMTEGALDRESKAEYNITITVTDLGTPRLKTEHSITLQVSDVNDNAPAFTQTSYTLFVRENNSPALHIGSVSATDRDSGTNAQVTYSLLPPQDPHLPLASLVSINADNGHLFALRSLDYEALQAFDFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYL

SEQ ID NO: 1744 - protein, 664 aa, synthetic construct
  REGION 1..664: note = PCDHGA1 (Q9Y5H4) ECD
GNIHYSVPEETDKGSFVGNIAKDLGLQPQELADGGVRIVSRGRMPLFALNPRSGSLITARRIDREELCAQSMPCLVSFNILVEDKMKLFPVEVEIIDINDNTPQFQLEELEFKMNEITTPGTRVSLPFGQDLDVGMNSLQSYQLSSNPHFSLDVQQGADGPQHPEMVLQSPLDREEEAVHHLILTASDGGEPVRSGTLRIYIQVVDANDNPPAFTQAQYHINVPENVPLGTQLLMVNATDPDEGANGEVTYSFHNVDHRVAQIFRLDSYTGEISNKEPLDFEEYKMYSMEVQAQDGAGLMAKVKVLIKVLDVNDNAPEVTITSVTTAVPENFPPGTIIALISVHDQDSGDNGYTTCFIPGNLPFKLEKLVDNYYRLVTERTLDRELISGYNITITAIDQGTPALSTETHISLLVTDINDNSPVFHQDSYSAYIPENNPRGASIFSVRAHDLDSNENAQITYSLIEDTIQGAPLSAYLSINSDTGVLYALRSFDYEQFRDMQLKVMARDSGDPPLSSNVSLSLFLLDQNDNAPEILYPALPTDGSTGVELAPLSAEPGYLVTKVVAVDRDSGQNAWLSYRLLKASEPGLFSVGLHTGEVRTARALLDRDALKQSLVVAVQDHGQPPLSATVTLTVAVADRISDILADLGSLEPSAKPNDSDLTLY

SEQ ID NO: 1745 - protein, 664 aa, synthetic construct
  REGION 1..664: note = PCDHGA10 (Q9Y5H3) ECD
RQISYSIPEELEKGSFVGNISKDLGLAPRELAERGVRIVSRGRTQLFSLNPRSGSLITAGRIDREELCAQSARCVVSFNILVEDRVKLFGIEIEVTDINDNAPKFQAENLDVKINENVAAGMRFPLPEAIDPDVGVNSLQSYQLSPNKHFSLRVQSRANGVKYPELVLEHSLDREEEAIHHLVLTASDGGDPLRSGTVLVSVTVFDANDNAPVFTLPEYRVSVPENLPVGTQLLTVTATDRDEGANGEVTYSFRKLPDTQLLKFQLNKYTGEIKISENLDYEETGFYEIEIQAEDGGAYLATAKVLITVEDVNDNSPELTITSLFSPVTEDSPLGTVVALLNVHDLDSEQNGQVTCSILAYLPFKLEKSIDSYYRLVIHRALDREQVSSYNITVTATDGGSPPLSTEAHFMLQVADINDNPPTFSQVSYFTYIPENNARGASIFSVTALDPDSKENAQIIYSLAEDTIQGVPLSSYISINSDTGVLYALRSFDYEQFHELQMQVTASDSGDPPLSSNVSLSLFVLDQNDNAPEILYPALPTDGSTGVELAPRSAEPGYLVTKVVAVDRDSGQNAWLSYRLLKASEPGLFAVGEHTGEVRTARALLDRDALKQSLVVAVQDHGQPPLSATVTLTVAVADSIPQVLADLGSFESPANSETSDLTLY

SEQ ID NO: 1746 - protein, 664 aa, synthetic construct
  REGION 1..664: note = PCDHGA11 (Q9Y5H2) ECD
RQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEVRTARALLDRDALKQSLVVAVQDHGQPPLSATVTLTVAVADSIPEVLADLGSLESLANSETSDLSLY

SEQ ID NO: 1747 - protein, 663 aa, synthetic construct
  REGION 1..663: note = PCDHGA12 (O60330) ECD
QIRYSVPEELEKGSRVGDISRDLGLEPRELAERGVRIIPRGRTQLFALNPRSGSLVTAGRIDREELCMGAIKCQLNLDILMEDKVKIYGVEVEVRDINDNAPYFRESELEIKISENAATEMRFPLPHAWDPDIGKNSLQSYELSPNTHFSLIVQNGADGSKYPELVLKRALDREEKAAHHLVLTASDGGDPVRTGTARIRVMVLDANDNAPAFAQPEYRASVPENLALGTQLLVVNATDPDEGVNAEVRYSFRYVDDKAAQVFKLDCNSGTISTIGELDHEESGFYQMEVQAMDNAGYSARAKVLITVLDVNDNAPEVVLTSLASSVPENSPRGTLIALLNVNDQDSEENGQVICFIQGNLPFKLEKSYGNYYSLVTDIVLDREQVPSYNITVTATDRGTPPLSTETHISLNVADTNDNPPVFPQASYSAYIPENNPRGVSLVSVTAHDPDCEENAQITYSLAENTIQGASLSSYVSINSDTGVLYALSSFDYEQFRDLQVKVMARDNGHPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADSIPQVLADLGSLESPANSETSDLTLY

SEQ ID NO: 1748 - protein, 664 aa, synthetic construct
  REGION 1..664: note = PCDHGA2 (Q9Y5H1) ECD
GQIRYSVREEIDRGSFVGNIAKDLGLEPLALAEQGVRIVSRGRSQLFALNPRSGSLVTANRIDREELCAQSAPCLLNFNILLEDKLTIYSVEVEITDINDNAPRFGVEELELKISETTTPGFRIPLKNAHDADVGENALQKYALNPNDHFSLDVRRGADGNKYPELVLERSLDREEEAVHHLVLVASDGGDPVLSGTSRICVKVLDANDNAPVFTQPEYRISIPENTLVGTRILTVTATDADEGYYAQVVYFLEKSPGETSEVFELKSTSGELTIIKDLDYEDATFHEIDIEAQDGPGLLTRAKVIVTVLDVNDNAPEFYMTSATSSVSEDSLPGTIIGLFNVHDRDSGQNAFTTCSLPEDLPFKLEKSVDNYYRLVTTRALDREQFSFYNITLTAKDGGNPSLSTDAHILLQVADINDNAPAFSRTSYSTYIPENNPRGASVFSVTAHDPDSNDNAHVTYSFAEDTVQGAPLSSYISINSDTGVLYALRSFDYEQLRDLQVWVIARDSGNPPLSSNVSLSLFVLDQNDNAPEILYPAFPTDGSTGVELAPRSAEPGYLVTKVVAVDRDSGQNAWLSYHLLKASEPGLFSVGLHTGEVRTARALLDRDALKQSLVVAIQDHGQPPLSATVTLTVAVADRIPDILADLGSLEPSAIPNDSDLTLY

SEQ ID NO: 1749 - protein, 663 aa, synthetic construct
  REGION 1..663: note = PCDHGA3 (Q9Y5H0) ECD
QIRYSVSEELDKGSFVGNIANDLGLEPRELAERGVRIVSRGRTQLFSLNPQSGSLVTAERIDREELCAQIPLCLVKINILVEDKLKIFEVEIEIKDINDNAPNFPTEELEIKIGELTVPGTRFPIKTAFDPDVGINSLQNYKLSPNDYFSLAVNSVSEGAKYPELVLERALDREKKEIHQLVLVASDGGDPVHSGNLHIQVIVLDANDNPPMFTQPEYRVSVWENVPVGTRLLTVNATDPDEGFNAQVSYILDKMPGKIAEIFHLNSVSGEVSILKSLDYEDAMFYEIKIEAQDGPGLLSRAKILVTVLDVNDNAPEITITSLTSSVPEEGTVGREIALIDVHDRDSGQNGQVEVFVLGNLPFKLEKSIDQYYRLVTATSLDREQISEYNISLRASDGGSPPLSTETHITLHVIDINDNPPTFPHLSYSAYIPENNPRGASIFSVTAQDPDSNNNARITYALTEDTLQGAPLSSFVSINSNTGVLYALRSFDYEQFRDLKLLVTASDSGNPPLSSNVSLNLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLY

SEQ ID NO: 1750 - protein, 664 aa, synthetic construct
  REGION 1..664: note = PCDHGA4 (Q9Y5G9) ECD
EQILYSVFEEQEEGSVVGNIAKDLGLAPRELAERGVRIVSRGRTQLFALNPRSGTLVTAGRIDREELCDRSPNCVTNLEILLEDTVKILRVEVEIIDVNDNPPSFGTEQREIKVAENENPGARFPLPEAFDPDVGVNSLQGYQLNSNGYFSLDVQSGADGIKYPELVLERALDREEEAVHHLVLTAFDGGDPVRSGTARILIILVDTNDNAPVFTQPEYHVSVRENVPVGTRLLTVKATDPDEGANGDVTYSFRKVRDKISQLFQLNSLSGDITILGGLDYEDSGFYDIDVEAHDGPGLRARSKVLVTVLDENDNAPEVTVTSLTSSVQESSSPGTVIALFNVHDSDSGGNGLVTCSIPDNLPFTLEKTYGNYYRLLTHRTLDREEVSEYNITVTATDQGTPPLSTETHISLQVMDINDNPPTFPHASYSAYIPENNPRGASILSMTAQDPDSGDNARITYSLAEDTFQGAPLSSYVSINSNTGILYALCSFDYEQFRDLQLLMTASDSGDPPLSSNVSLSLFVLDQNDNVPEILYPTFPTDGSTGVELAPRSADSGYLVTKVVAVDRDSGQNAWLSYSLLKSSEPGLFAVGLHTGEVRTARALLDRDALKQRLVVVVQDHGQPPLSATVTLTVAVADSIPDVLADLGSLKPSADPDDSGLTLY

SEQ ID NO: 1751 - protein, 663 aa, synthetic construct
  REGION 1..663: note = PCDHGA5 (Q9Y5G8) ECD
QIRYSMPEELDKGSFVGNIAKDLGLEPQELAERGVRIVSRGRTQLFALNPRSGSLVTAGRIDREELCAQSPLCVVNFNILVENKMKIYGVEVEIIDINDNFPRFRDEELKVKVNENAAAGTRLVLPFARDADVGVNSLRSYQLSSNLHFSLDVVSGTDGQKYPELVLEQPLDREKETVHDLLLTALDGGDPVLSGTTHIRVTVLDANDNAPLFTPSEYSVSVPENIPVGTRLLMLTATDPDEGINGKLTYSFRNEEEKISETFQLDSNLGEISTLQSLDYEESRFYLMEVVAQDGGALVASAKVVVTVQDVNDNAPEVILTSLTSSISEDCLPGTVIALFSVHDGDSGENGEIACSIPRNLPFKLEKSVDNYYHLLTTRDLDREETSDYNITLTVMDHGTPPLSTESHIPLKVADVNDNPPNFPQASYSTSVTENNPRGVSIFSVTAHDPDSGDNARVTYSLAEDTFQGAPLSSYVSINSDTGVLYALRSFDYEQLRDLQLWVTASDSGNPPLSSNVSLSLFVLDQNDNTPEILYPALPTDGSTGVELAPRSAEPGYLVTKVVAVDKDSGQNAWLSYRLLKASEPGLFAVGLHTGEVRTARALLDRDALKQSLVVAVEDHGQPPLSATFTVTVAVADRIPDILADLGSIKTPIDPEDLDLTLY

SEQ ID NO: 1752 - protein, 663 aa, synthetic construct
  REGION 1..663: note = PCDHGA6 (Q9Y5G7) ECD
QIRYSIPEELEKGSFVGNIVKDLGLEPQELAEHGVRIVSRGRMQLFSLNPRNGSLVTAGRIDREELCAQSPRCLVSFNILVEDKLNLYPVEVEIVDINDNTPRFLKEELEVKILENAAPSSRFPLMEVYDPDVGMNSLQGFKLSGNSHFSVDVQSEAHGPKYPELVLEGTLDREGEAVYRLVLTAMDGGDPVRSSVAQILVTVLDVNDNTPMFTQPVYRVSVPENLPVGTPVLAVTATDQDEGVHGEVTYSFVKITEKISQIFCLNVLTGEISTSANLDYEDSSFYELGVEARDGPGLRDRAKVLITILDVNDNVPEVVVTSGSRTIAESAPPGTVIALFQVFDRDSGLNGLVTCSIPRSLPFELEKSVGNYYRLVTNAALDREEVFLYNITVTATDKGTPPLSTETIISLNVADTNDNPPTFPHSSYSVYVLENNPRGASIFSVNALDPDVDQNAQVSYSLAEDTLQGAPLSSYVSINSDTGILYALRSFDYEQLRDLQLWVTASDSGDPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLY

SEQ ID NO: 1753 - protein, 664 aa, synthetic construct
  REGION 1..664: note = PCDHGA7 (Q9Y5G6) ECD
GRILYSVSEETDKGSFVGDIAKDLGLEPRELAERGVRIISRGRTQLFALNQRSGSLVTAGRIDREEICAQSARCLVNFNILMEDKMNLYPIDVEIIDINDNVPRFLTEEINVKIMENTAPGVRFPLSEAGDPDVGTNSLQSYQLSPNRHFSLAVQSGDDETKYPELVLERVLDREEERVHHLVLTASDGGDPPRSSTAHIQVTVVDVNDHTPVFSLPQYQVTVPENVPVGTRLLTVHAIDLDEGVNGEVTYSFRKITPKLPKMFHLNSLTGEISTLEGLDYEETAFYEMEVQAQDGPGSLTKAKVLITVLDVNDNAPEVTMTSLSSSIPEDTPLGTVIALFYLQDRDSGKNGEVTCTIPENLPFKLEKSIDNYYRLVTTKNLDRETLSLYNITLKATDGGTPPLSRETHIFMQVADTNDNPPTFPHSSYSVYIAENNPRGASIFLVTAQDHDSEDNAQITYSLAEDTIQGAPVSSYVSINSDTGVLYALQSFDYEQLRELQLRVTAHDSGDPPLSSNMSLSLFVLDQNDNPPEILYPALPTDGSTGMELAPRSAEPGYLVTKVVAVDKDSGQNAWLSYLLLKASEPGLFAVGLYTGEVRTARALLDRDALKQSLVVAVQDHGQPPLSATVTLTVAVADSIPEVLADLGSLEPSDGPYNYDLTLY

SEQ ID NO: 1754 - protein, 663 aa, synthetic construct
  REGION 1..663: note = PCDHGA8 (Q9Y5G5) ECD
QIRYSVPEETDKGSFVGNISKDLGLDPRKLAKHGVRIVSRGRTQLFALNPRSGSLITAGRIDREELCAQSPRCLININTLVEDKGKLFGVEIEIIDINDNNPKFQVEDLEVKINEIAVPGARYPLPEAVDPDVGVNSLQSYQLSPNHHFSLDVQTGDNGAINPELVLERALDREEEAAHHLVLTASDGGKPPRSSTVRIHVTVLDTNDNAPVFPHPIYRVKVLENMPPGTRLLTVTASDPDEGINGKVAYKFRKINEKQTPLFQLNENTGEISIAKSLDYEECSFYEMEIQAEDVGALLGRTKLLISVEDVNDNRPEVIITSLFSPVLENSLPGTVIAFLSVHDQDSGKNGQVVCYTRDNLPFKLEKSIGNYYRLVTRKYLDRENVSIYNITVMASDLGTPPLSTETQIALHVADINDNPPTFPHASYSAYILENNLRGASIFSLTAHDPDSQENAQVTYSVTEDTLQGAPLSSYISINSDTGVLYALQSFDYEQIRDLQLLVTASDSGDPPLSSNMSLSLFVLDQNDNAPEILYPALPTDGSTGVELAPRSAERGYLVTKVVAVDRDSGQNAWLSYRLLKASEPGLFSVGLHTGEVRTARALLDRDALKQSLVVAVQDHGQPPLSATVTLTVAVADSIPEVLTELGSLKPSVDPNDSSLTLY

SEQ ID NO: 1755 - protein, 664 aa, synthetic construct
  REGION 1..664: note = PCDHGA9 (Q9Y5G4) ECD
SQIRYSVPEETEKGYIVGNISKDLALEPRELAERRVRIVSRGRTQLFSLNPRSGTLVTAGRIDREELCAQSPRCLVNFKVLVEDRVKLYGIEIEVTDINDSAPKFQAESLEVKINEIAVPGARYPLPEAIDPDVGVNSLQSYQLSPNHHFSLNVQTGDNGAINPELVLERALDREEATAHHLVLTASDGGEPRRSSTVRIHVTVLDTNDNAPVFAQRIYRVKVLENVPPGTWLLTATASDLDEGINGKVAYKFWKINEKQSLLFQLNENTGEISTAKSLDYEECSFYEMEIQAEDGGGLKGWTKVLISVEDVNDNRPEVTITSLFSPVREDAPQGTVILLFNAHDRDSGKNGQVVCSIQENLSFTLENSEEDYYRLLTAQILDREKASEYNITVTATDRGTPPLSTEIHITLQVTDINDNPPAFSQASYSVYLPENNARGTSIFSVIAYDPDSNENSRVIYSLAEDTIQGSPLSTYVSINSDTGVLYALCSFDYEQFRDLQMQVTASDSGSPPLSSNVSLRLFVLDQNDNAPEILYPALPTDGSTGVELAPRSAEPGYLVTKVVAVDRDSGQNAWLSYRLFKASEPGLFSVGLHTGEVRTARALLDRDALKQSLVVAVQDHGQPPLSATVTLTVAIADSIPDILADLGSLQIPADLEASDLTLY

SEQ ID NO: 1756 - protein, 659 aa, synthetic construct
  REGION 1..659: note = PCDHGB1 (Q9Y5G3) ECD
QQIRYTIPEELANGSRVGKLAKDLGLSVRELPTRKLRVSAEDYFNVSLESGDLLVNGRIDREKICGRKLECALEFETVAENPMNVFHVVVVIQDINDNAPRFVAKGIDLEICESALPGVKFSLDSAQDADVEGNSLKLYTINPNQYFSLSTKESPDGSKYPVLLLEKPLDREHQSSHRLILTAMDGGDPPLSGTTHIWIRVTDANDNAPVFSQEVYRVSLQENVPWGTSVLRVMATDQDEGINAEITYAFLNSPISTSLFNLNPNTGDITTNGTLDFEETSRYVLSVEAKDGGVHTAHCNVQIEIVDENDNAPEVTFMSFSNQIPEDSDLGTVIALIKVRDKDSGQNGMVTCYTQEEVPFKLESTSKNYYKLVIAGALNREQTADYNVTIIATDKGKPALSSRTSITLHISDINDNAPVFHQASYVVHVSENNPPGASIAQVSASDPDLGPNGRVSYSILASDLEPRELLSYVSVSPQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRPEPSDPQTELQFY

SEQ ID NO: 1757 - protein, 661 aa, synthetic construct
  REGION 1..661: note = PCDHGB2 (Q9Y5G2) ECD
VQIRYSIPEELAKNSVVGNLAKDLGLSVRDLPARKLRVSAEKEYFTVNPESGDLLVSDRIDREQICGKQPLCVLDFDTVAENPLNIFYIAVIVQDINDNTPLFKQTKINLKIGESTKPGTTFPLDPALDSDVGPNSLQRYHLNDNEYFDLAEKQTPDGRKYPELILKHSLDREEHSLHQLVLTAVDGGDPPQSGTTQIRIKVTDANDNPPVFSQDVYRVTLREDVPPGFFVLQVTATDRDEGINAEITYSFHNVDEQVKHFFNLNEKTGEITTKDDLDFEIASSYTLSIEAKDPGDLAAHCSIQVEILDDNDCAPEVIVTSVSTPLPEDSPPGTVIALIKTRDRDSGENGEVYCQVLGNAKFILKSSSKNYYKLVTDGALDREEIPEYNLTITATDGGKPPLSSSIIVTLHISDVNDNAPVFQQTSYMVHVAENNPPGASIAQISASDPDLGPSGQVSYSIVASDLKPREILSYVSVSAQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRREPSDPQAKLQFY

SEQ ID NO: 1758 - protein, 661 aa, synthetic construct
  REGION 1..661: note = PCDHGB3 (Q9Y5G1) ECD
EPIRYAIPEELDRGSLVGNLAKDLGFGVGDLPTRNLRVIAEKKFFTVSPENGNLLVSDRIDREEICGKKSTCVLEFEMVAEKPLNFFHVTVLIQDINDNPPTFSQNITELEISELALTGATFALESAQDPDVGVNSLQQYYLSPDPHFSLIQKENLDGSRYPELVLKAPLDREEQPHHHLVLTAVDGGEPSRSCTTQIRVIVADANDNPPVFTQDMYRVNVAENLPAGSSVLKVMAIDMDEGINAEIIYAFINIGKEVRQLFKLDSKTGELTTIGELDFEERDSYTIGVEAKDGGHHTAYCKVQIDISDENDNAPEITLASESQHIQEDAELGTAVALIKTHDLDSGFNGEILCQLKGNFPFKIVQDTKNTYRLVTDGALDREQIPEYNVTITATDKGNPPLSSSKTITLHILDVNDNVPVFHQASYTVHVAENNPPGASIAHVRASDPDLGPNGLVSYYIVASDLEPRELSSYVSVSARSGVVFAQRAFDHEQLRAFELTLQARDQGSPTLSANVSLRVLVDDRNDNAPLVLYPALGPEGSALFDMVPRSAEPGYLVTKVVAVDADSGYNAWLSYHIVQASEPGLFSLGLRTGEVRTARTLGDREAARQRLLVTVRDGGQQPLSATVMLHLIFADSLQEIQPDLSDRPTPSDPQAELQFH

SEQ ID NO: 1759 - protein, 659 aa, synthetic construct
  REGION 1..659: note = PCDHGB4 (Q9UN71) ECD
EQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILGSAHDADIGSNTLQNYQLSPSDHFSLINKEKSDGSKYPEMVLKTPLDREKQKSYHLTLTALDFGAPPLSSTAQIHVLVTDANDNAPVFSQDVYRVSLSENVYPGTTVLQVTATDQDEGVNAEITFSFSEASQITQFDLNSNTGEITVLNTLDFEEVKEYSIVLEARDGGGMIAQCTVEVEVIDENDNAPEVIFQSLPNLIMEDAELGTHIALLKVRDKDSRHNGEVTCKLEGDVPFKILTSSRNTYKLVTDAVLDREQNPEYNITVTATDRGKPPLSSSSSITLHIGDVNDNAPVFSQSSYIVHVAENNPPGASISQVRASDPDLGPNGQVSYCIMASDLEQRELSSYVSISAESGVVFAQRAFDHEQLRAFELTLQARDQGSPALSANVSLRVLVDDRNDNAPRVLYPALGPDGSALFDMVPHAAEPGYLVTKVVAVDADSGHNAWLSYHVLQASEPGLFSLGLRTGEVRTARALGDRDAVRQRLLVAVRDGGQPPLSATATLHLVFADSLQEVLPDITDRPDPSDLQAELQFY

SEQ ID NO: 1760 - protein, 657 aa, synthetic construct
  REGION 1..657: note = PCDHGB5 (Q9Y5G0) ECD
EQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILEVAEDADIGLNSLQKYKLSLNPSFSLIIKEKQDGSKYPELALEKTLDREQQSYHRLVLTALDGGHPPLSGTTELRIQVTDANDNPPVFNRDVYRVSLRENVPPGTTVLQVSATDQDEGINSEITYSFYRTGQIFSLNSKSGEITTQKKLDFEETKEYSMVVEGRDGGGLVAQCTVEINIQDENDNSPEVTFHSLLEMILENAVPGTLIALIKIHDQDSGENGEVNCQLQGEVPFKIISSSKNSYKLVTDGTLDREQTPEYNVTITATDRGKPPLSSSISVILHIRDVNDNAPVFHQASYLVSVPENNPPGASIAQVCASDLDLGLNGQVSYSIMASDLEPLALASYVSMSAQSGVVFAQRAFDYEQLRTFELTLQARDQGSPALSANVSLRVLVGDRNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLVFADSLQEVLPDITDRPVPSDPQAELQFY

SEQ ID NO: 1761 - protein, 661 aa, synthetic construct
  REGION 1..661: note = PCDHGB6 (Q9Y5F9) ECD
EPIRYSIPEELAKGSVVGNLAKDLGLSVLDVSARKLRVSAEKLHFSVDAESGDLLVKNRIDREQICKERRRCELQLEAVVENPLNIFHVIVVIEDVNDHAPQFDKKEIHLEIFESASAGTRLSLDPATDPDININSIKDYKINSNPYFSLMVRVNSDGGKYPELSLEKLLDREEQRSHSLILTALDGGDPPRSATAHIEISVKDTNDNPPVFSRDEYRISLSENLPPGSPVLQVTATDQDEGVNAEINYYFRSTAQSTKHMFSLDEKTGMIKNNQSFDFEDVERYTMEVEAKDGGGLSTQCKVIIEILDENDNSPEIIITSLSDQILENSPPGMVVALFKTRDLDFGGNGEVRCNIETDIPFKIYSSSNNYYKLVTDGALDREQTPEYNVTIVATDRGKPPLSSSRSITLYVADINDNAPVFDQTSYVVHVAENNPPGASIAQVSASDPDLGLNGHISYSIVASDLEPLAVSSYVSVSAQSGVVFAQRAFDHEQLRAFALTLQARDHGSPTLSANVSLRVLVGDRNDNAPRVLYPALGPDGSAFFDMVPRSAEPGYLVTKVVAVDADSGHNAWLSYHVLQASEPGLFSLGLRTGEVRTARALGDRDAARQRLLVAVRDGGQPPLSATATLHLVFADNLQEILPDLSDRPVLSDPQAELQFY

SEQ ID NO: 1762 - protein, 661 aa, synthetic construct
  REGION 1..661: note = PCDHGB7 (Q9Y5F8) ECD
EPIRYSIPEELAKGSVVGNLAKDLGLSVLDVSARELRVSAEKLHFSVDAQSGDLLVKDRIDREQICKERRRCELQLEAVVENPLNIFHVIVVIEDVNDHAPQFRKDEINLEISESVSLGMGTILESAEDPDISMNSLSKYQLSPNEYFSLVEKDNPDGGKYPELVLQKTLDRETQSAHHLVLTALDGGDPPRSGTAQIRILVIDANDNPPVFSQDVYRVSLREDVPPGTSILRVKATDQDEGINSEITYSFFGVADKAQHVFSLDYTTGNILTQQPLDFEEVERYTINIEAKDRGSLSTRCKVIVEVVDENDNSPEIIITSLSDQIMEDSPPGVVVALFKTRDQDSGENGEVRCSLSRGVPFKIHSSSNNYYKLVTDEALDREQTPEYNVTIAATDRGKPPLSSSKTITLHITDVNDNAPVFGQSAYLVHVPENNQPGASIAQVSASDPDFGLNGRVSYSLIASDLESRTLSSYVSVSAQSGVVFAQRAFDHEQLRTFELTLQARDQGSPALSANVSLRVLVGDRNDNAPRVLYPALGPDGSALFDTVPRAAQPGYLVTKVVAVDADSGHNAWLSYHVVQASEPGLFSLGLRTGEVRMVRALGDKDSVRQRLLVAVRDGGQPPLSATATLHLVFADSLQEVLPDFSDHPTPSDSQAEMQFY

SEQ ID NO: 1763 - protein, 662 aa, synthetic construct
  REGION 1..662: note = PCDHGC3 (Q9UN70) ECD
VIHYEIPEEREKGFAVGNVVANLGLDLGSLSARRFRVVSGASRRFFEVNRETGEMFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPREQKKNLTFY

SEQ ID NO: 1764 - protein, 663 aa, synthetic construct
  REGION 1..663: note = PCDHGC4 (Q9Y5F7) ECD
QIRYPVPEESQEGTFVGNVAQDFLLDTDSLSARRLQVAGEVNQRHFRVDLDSGALLIKNPIDREALCGLSASCIVPLEFVTEGPLEMYRAEVEIVDVNDHAPRFPRQQLDLEIGEAAPPGQRFPLEKAQDADVGSNSISSYRLSSNEHFALDVKKRSDGSLVPELLLEKPLDREKQSDYRLVLTAVDGGNPPRSGTAELRVSVLDVNDNAPAFQQSSYRISVLESAPAGMVLIQLNASDPDLGPSGNVTFYFSGHTPDRVRNLFSLHPTTGKLTLLGPLDFESENYYEFDVRARDGGSPAMEQHCSLRVDLLDVNDNAPYITVTSELGTLPESAEPGTVVALISVQDPDSGSNGDVSLRIPDHLPFALKSAFRNQFSLVTAGPLDREAKSSYDIMVTASDAGNPPLSTHRTIFLNISDVNDNPPSFFQRSHEVFVPENNRPGDLLCSLAASDPDSGLNALISYSLLEPRNRDVSASSFISLNPQTGAVHATRSFDYEQTQTLQFEVQARDRGNPPLSSTVTVRLFVLDLNDNAPAVLRPRARPGSLCPQALPPSVGAGHLITKVTAVDLDSGYNAWVSYQLLEAPDPSLFAVSRYAGEVRTAVPIPADLPPQKLVIVVKDSGSPPLSTSVTLLVSLEEDTHPVVPDLRESSAPREGESRLTLY

SEQ ID NO: 1765 - protein, 664 aa, synthetic construct
  REGION 1..664: note = PCDHGC5 (Q9Y5F6) ECD
QLRYSVVEESEPGTLVGNVAQDLGLKMTDLLSRRLQLGSEENGRYFSLSLMSGALAVNQKIDRESLCGASTSCLLPVQVVTEHPLELIRVEVEILDLNDNSPSFATPEREMRISESAASGARFPLDSAQDPDVGTNTVSFYTLSPNSHFSLNVKTLKDGKPFPELVLEQQLDREAQARHQLVLTAVDGGTPARSGTTLISVIVLDINDNAPTFQSSVLRVGIPENAPIGTLLLRLNATDPDEGTNGQLDYSFGDHTSEAVRNLFGLDPSSGAIHVLGPIDFEESRFYEIHARARDQGQPAMEGHCVIQVDVGDVNDNAPEVLLASLANPVLESTPVGTVVGLFNVRDRDSGRNGEVSLDISPDLPFQIKPSENHYSLLTSQPLDREATSHYIIELLASDAGSPSLHKHLTIRLNISDVNDNAPRFNQQLYTAYILENRPPGSLLCTVAASDPDTGDNARLTYSIVGNQVQGAPASSFVYVNPEDGRIFAQRTFDYELLQMLQIVVGVRDSGSPPLHANTSLHVFVLDENDNAPAVLHPRPDWEHSAPQRLPRSAPPGSLVTKVTAVDADAGHNAWLSYSLLPQSTAPGLFLVSTHTGEVRTARALLEDDSDTQQVVVLVRDNGDPSLSSTATVLLVLEDEDPEEMPKSSDFLIHPPERSDLTLY

SEQ ID NO: 1766 - protein, 1629 aa, synthetic construct
  REGION 1..1629: note = PCSK5 (Q92824) ECD
DYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKT

SEQ ID NO: 1767 - protein, 147 aa, synthetic construct
  REGION 1..147: note = PDCD1 (Q15116) ECD
FLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLV

SEQ ID NO: 1768 - protein, 201 aa, synthetic construct
  REGION 1..201: note = PDCD1LG2 (Q9BQ51) ECD
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1769 - protein, 505 aa, synthetic construct
  REGION 1..505: note = PDGFRA (P16234) ECD
QLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVA

SEQ ID NO: 1770 - protein, 500 aa, synthetic construct
  REGION 1..500: note = PDGFRB (P09619) ECD
LVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKV

SEQ ID NO: 1771 - protein, 735 aa, synthetic construct
  REGION 1..735: note = PEAR1 (Q5VY43) ECD
LNPSDPNTCSFWESFTTTTKESHSRPFSLLPSEPCERPWEGPHTCPQPTVVYRTVYRQVVKTDHRQRLQCCHGFYESRGFCVPLCAQECVHGRCVAPNQCQCVPGWRGDDCSSECAPGMWGPQCDKPCSCGNNSSCDPKSGVCSCPSGLQPPNCLQPCTPGYYGPACQFRCQCHGAPCDPQTGACFCPAERTGPSCDVSCSQGTSGFFCPSTHSCQNGGVFQTPQGSCSCPPGWMGTICSLPCPEGFHGPNCSQECRCHNGGLCDRFTGQCRCAPGYTGDRCREECPVGRFGQDCAETCDCAPDARCFPANGACLCEHGFTGDRCTDRLCPDGFYGLSCQAPCTCDREHSLSCHPMNGECSCLPGWAGLHCNESCPQDTHGPGCQEHCLCLHGGVCQATSGLCQCAPGYTGPHCASLCPPDTYGVNCSARCSCENAIACSPIDGECVCKEGWQRGNCSVPCPPGTWGFSCNASCQCAHEAVCSPQTGACTCTPGWHGAHCQLPCPKGQFGEGCASRCDCDHSDGCDPVHGRCQCQAGWMGARCHLSCPEGLWGVNCSNTCTCKNGGTCLPENGNCVCAPGFRGPSCQRSCQPGRYGKRCVPCKCANHSFCHPSNGTCYCLAGWTGPDCSQPCPPGHWGENCAQTCQCHHGGTCHPQDGSCICPLGWTGHHCLEGCPLGTFGANCSQPCQCGPGEKCHPETGACVCPPGHSGAPCRIGIQEPFTVMPTTPVAYNSL

SEQ ID NO: 1772 - protein, 574 aa, synthetic construct
  REGION 1..574: note = PECAM1 (P16284) ECD
QENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKK

SEQ ID NO: 1773 - protein, 400 aa, synthetic construct
  REGION 1..400: note = PI16 (Q6UXB8) ECD
LTDEEKRLMVELHNLYRAQVSPTASDMLHMRWDEELAAFAKAYARQCVWGHNKERGRRGENLFAITDEGMDVPLAMEEWHHEREHYNLSAATCSPGQMCGHYTQVVWAKTERIGCGSHFCEKLQGVEETNIELLVCNYEPPGNVKGKRPYQEGTPCSQCPSGYHCKNSLCEPIGSPEDAQDLPYLVTEAPSFRATEASDSRKMGTPSSLATGIPAFLVTEVSGSLATKALPAVETQAPTSLATKDPPSMATEAPPCVTTEVPSILAAHSLPSLDEEPVTFPKSTHVPIPKSADKVTDKTKVPSRSPENSLDPKMSLTGARELLPHAQEEAEAEAELPPSSEVLASVFPAQDKPGELQATLDHTGHTSSKSLPNFPNTSATANATGGRALALQSSLPGAEG

SEQ ID NO: 1774 - protein, 620 aa, synthetic construct
  REGION 1..620: note = PIGR (P01833) ECD
KSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSR

SEQ ID NO: 1775 - protein, 506 aa, synthetic construct
  REGION 1..506: note = PIGT (Q969N2) ECD
LAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYN

SEQ ID NO: 1776 - protein, 147 aa, synthetic construct
  REGION 1..147: note = PIK3IP1 (Q96FE7) ECD
SGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGT

SEQ ID NO: 1777 - protein, 178 aa, synthetic construct
  REGION 1..178: note = PILRA (Q9UKJ1) ECD
QPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQAVTTTTQRPSSMTTTWRLSSTTTTTGLRVTQGKRRSDSWHISLETA

SEQ ID NO: 1778 - protein, 172 aa, synthetic construct
  REGION 1..172: note = PILRB (Q9UKJ0) ECD
QPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRVELDTRRSGRQQLQSIKGTKLTITQAVTTTTTWRPSSTTTIAGLRVTESKGHSESWHLSLDTAIR

SEQ ID NO: 1779 - protein, 3835 aa, synthetic construct
  REGION 1..3835: note = PKHD1 (P08F94) ECD
HIEPEEGSLAGGTWITVIFDGLELGVLYPNNGSQLEIHLVNVNMVVPALRSVPCDVFPVFLDLPVVTCRTRSVLSEAHEGLYFLEAYFGGQLVSSPNPGPRDSCTFKFSKAQTPIVHQVYPPSGVPGKLIHVYGWIITGRLETFDFDAEYIDSPVILEAQGDKWVTPCSLINRQMGSCYPIQEDHGLGTLQCHVEGDYIGSQNVSFSVFNKGKSMVHKKAWLISAKQDLFLYQTHSEILSVFPETGSLGGRTNITITGDFFDNSAQVTIAGIPCDIRHVSPRKIECTTRAPGKDVRLTTPQPGNRGLLFEVGDAVEGLELTEATPGYRWQIVPNASSPFGFWSQEGQPFRARLSGFFVAPETNNYTFWIQADSQASLHFSWSEEPRTKVKVASISVGTADWFDSWEQNRDEGTWQQKTPKLELLGGAMYYLEAEHHGIAPSRGMRIGVQIHNTWLNPDVVTTYLREKHQIRVRAQRLPEVQVLNVSGRGNFFLTWDNVSSQPIPANATAHLIQTTIEELLAVKCKLEPLWSNILLRLGFERGPEVSNSDGDLTSGTEPFCGRFSLRQPRHLVLTPPAAQKGYRLDQYTHLCLAYKGHMNKILKMIVSFTIGFQNMVKNTTCDWSLTRTSPESWQFDCTDLWETCVRCFGDLQPPPANSPVLVHQINLLPLAQETGLFYVDEIIIADTNVTVSQADSGTARPGGNLVESVSVVGSPPVYSVTSWLAGCGTELPLITARSVPTEGTEEGSGLVLVTTQRRQRTSPPLGGHFRIQLPNTVISDVPVQISAHHLHQLLQNNADDFTSRYLNASDFTVKEDLYTCYEHVWTLSWSTQIGDLPNFIRVSDENLTGVNPAAATRVVYDGGVFLGPIFGDMLATANQHTQVVVRVNDVPAHCPGSCSFQYLQGSTPCVHSVWYSIDGDINLMIYITGTGFSGDSQFLQVTVNKTSCKVIFSNQTNVVCQTDLLPVGMHRILMLVRPSGLAISATGEDLFLNVKPRLDMVEPSRAADIGGLWATIRGSSLEGVSLILFGSYSCAINVATSNSSRIQCKVPPRGKDGRIVNVTVIRGDYSAVLPRAFTYVSSLNPVIVTLSRNISNIAGGETLVIGVARLMNYTDLDVEVHVQDALAPVHTQSAWGLEVALPPLPAGLHRISVSINGVSIHSQGVDLHIQYLTEVFSIEPCCGSLLGGTILSISGIGFSRDPALVWVLVGNRSCDIVNLTEASIWCETLPAPQIPDAGAPTVPAAVEVWAGNRFFARGPSPSLVGKGFTFMYEAAATPVVTAMQGEITNSSLSLHVGGSNLSNSVILLGNLNCDVETQSFQGNVSLSGCSIPLHSLEAGIYPLQVRQKQMGFANMSVVLQQFAVMPRIMAIFPSQGSACGGTILTVRGLLLNSRRRSVRVDLSGPFTCVILSLGDHTILCQVSLEGDPLPGASFSLNVTVLVNGLTSECQGNCTLFIREEASPVMDALSTNTSGSLTTVLIRGQRLATTADEPMVFVDDQLPCNVTFFNASHVVCQTRDLAPGPHYLSVFYTRNGYACSGNVSRHFYIMPQVFHYFPKNFSLHGGSLLTIEGTGLRGQNTTSVYIDQQTCLTVNIGAELIRCIVPTGNGSVALEIEVDGLWYHIGVIGYNKAFTPELISISQSDDILTFAVAQISGAANIDIFIGMSPCVGVSGNHTVLQCVVPSLPAGEYHVRGYDCIRGWASSALVFTSRVIITAVTENFGCLGGRLVHVFGAGFSPGNVSAAVCGAPCRVLANATVSAFSCLVLPLDVSLAFLCGLKREEDSCEAARHTYVQCDLTVAMATEQLLESWPYLYICEESSQCLFVPDHWAESMFPSFSGLFISPKLERDEVLIYNSSCNITMETEAEMECETPNQPITVKITEIRKRWGQNTQGNFSLQFCRRWSRTHSWFPERLPQDGDNVTVENGQLLLLDTNTSILNLLHIKGGKLIFMAPGPIELRAHAILVSDGGELRIGSEDKPFQGRAQITLYGSSYSTPFFPYGVKFLAVRNGTLSLHGSLPEVIVTCLRATAHALDTVLALEDAVDWNPGDEVVIISGTGVKGAKPMEEIVTVETVQDTDLYLKSPLRYSHNFTENWVAGEHHILKATVALLSRSITIQGNLTNEREKLLVSCQEANAPEGNLQHCLYSMSEKMLGSRDMGARVIVQSFPEEPSQVQLKGVQFQVLGQAFHKHLSSLTLVGAMRESFIQGCTVRNSFSRGLSMCGTLGLKVDSNVFYNILGHALLVGTCTEMRYISWEAIHGRKDDWSGHGNIIRNNVIIQVSGAEGLSNPEMLTPSGIYICSPTNVIEGNRVCGAGYGYFFHLMTNQTSQAPLLSFTQNIAHSCTRYGLFVYPKFQPPWDNVTGTTLFQSFTVWESAGGAQIFRSSNLRLKNFKVYSCRDFGIDVLESDANTSVTDSLLLGHFAHKGSLCMSSGIKTPKRWELMVSNTTFVNFDLINCVAIRTCSDCSQGQGGFTVKTSQLKFTNSSNLVAFPFPHAAILEDLDGSLSGKNRSHILASMETLSASCLVNSSFGRVVHGSACGGGVLFHRMSIGLANTPEVSYDLTMTDSRNKTTTVNYVRDTLSNPRGWMALLLDQETYSLQSENLWINRSLQYSATFDNFAPGNYLLLVHTDLPPYPDILLRCGSRVGLSFPFLPSPGQNQGCDWFFNSQLRQLTYLVSGEGQVQVILRVKEGMPPTISASTSAPESALKWSLPETWQGVEEGWGGYNNTIPGPGDDVLILPNRTVLVDTDLPFFKGLYVMGTLDFPVDRSNVLSVACMVIAGGELKVGTLENPLEKEQKLLILLRASEGVFCDRMNGIHIDPGTIGVYGKVHLYSAYPKNSWTHLGADIASGNERIIVEDAVDWRPHDKIVLSSSSYEPHEAEVLTVKEVKGHHVRIYERLKHRHIGSVHVTEDGRHIRLAAEVGLLTRNIQIQPDVSCRGRLFVGSFRKSSREEFSGVLQLLNVEIQNFGSPLYSSVEFSNVSAGSWIISSTLHQSCGGGIHAAASHGVLLNDNIVFGTAGHGIDLEGQAYTVTNNLVVLMTQPAWSTIWVAGIKVNQVKDINLHGNVVAGSERLGFHIRGHKCSSCELLWSDNVAHSSLHGLHLYKESGLDNCTRISGFLAFKNFDYGAMLHVENSVEIENITLVDNTIGLLAVVYVFSAPQNSVKKVQIVLRNSVIVATSSSFDCIQDKVKPHSANLTSTDRAPSNPRGGRIGILWPVFTSEPNQWPQEPWHKVRNDHSISGIMKLQDVTFSSFVKSCYSDDLDVCILPNAENSGIMHPITAERTRMLKIKDKNKFYFPSLQPRKDLGKVVCPELDCASPRKYLFKDLDGRALGLPPPVSVFPKTEAEWTASFFNAGTFREEQKCTYQFLMQGFICKQTDQVVLILDSADAIWAIQKLYPVVSVTSGFVDVFSSVNANIPCSTSGSVSTFYSILPIRQITKVCFMDQTPQVLRFFLLGNKSTSKLLLAVFYHELQSPHVFLGESFIPPTLVQSASLLLNESIGANYFNIMDNLLYVVLQGEEPIEIRSGVSIHLALTVMVSVLEKGWEIVILERLTNFLQIGQNQIRFIHEMPGHEETLKAIADSRAKRKRNCPTVTCTSHYRRVGQRRPLMMEMNSHRASPPMTVETISKVIVIEIGDSPTVRSTGMISSLSSNKLQNLAHRVITAQQTGVLENVLNMTIGALLVTQSKGVIGYGNTSSFKTGNLIYIRPYALSILVQPSDGEVGNELPVQPQLVFLDEQNRRVESLGPPSEPWTISASLEGASDSVLKGCTQAETQDGYVSFYNLAVLISGSNWHFIFTVTSPPGVNFTARSKPFAVLPVTRKEKST

SEQ ID NO: 1780 - protein, 4190 aa, synthetic construct
  REGION 1..4190: note = PKHD1L1 (Q86WI1) ECD
DPSTDGSQIIPKVTEIIPKYGSINGATRLTIRGEGFSQANQFNYGVDNAELGNSVQLISSFQSITCDVEKDASHSTQITCYTRAMPEDSYTVRVSVDGVPVTENNTCKGHINSWECTFNAKSFRTPTIRSITPLSGTPGTLITIQGRIFTDVYGSNIALSSNGKNVRILRVYIGGMPCELLIPQSDNLYGLKLDHPNGDMGSMVCKTTGTFIGHHNVSFILDNDYGRSFPQKMAYFVSSLNKIAMFQTYAEVTMIFPSQGSIRGGTTLTISGRFFDQTDFPVRVLVGGEPCDILNVTENSICCKTPPKPHILKTVYPGGRGLKLEVWNNSRPIRLEEILEYNEKTPGYMGASWVDSASYIWLMEQDTFVARFSGFLVAPDSDVYRFYIKGDDRYAIYFSQTGLPEDKVRIAYHSANANSYFSSPTQRSDDIHLQKGKEYYIEILLQEYRLSAFVDVGLYQYRNVYTEQQTGDAVNEEQVIKSQSTILQEVQVITLENWETTNAINEVQKIKVTSPCVEANSCSLYQYRLIYNMEKTVFLPADASEFILQSALNDLWSIKPDTVQVIRTQNPQSYVYMVTFISTRGDFDLLGYEVVEGNNVTLDITEQTKGKPNLETFTLNWDGIASKPLTLWSSEAEFQGAVEEMVSTKCPPQIANFEEGFVVKYFRDYETDFNLEHINRGQKTAETDAYCGRYSLKNPAVLFDSADVKPNRRPYGDILLFPYNQLCLAYKGFLANYIGLKFQYQDNSKITRSTDTQFTYNFAYGNNWTYTCIDLLDLVRTKYTGTNVSLQRISLHKASESQSFYVDVVYIGHTSTISTLDEMPKRRLPALANKGIFLEHFQVNQTKTNGPTMTNQYSVTMTSYNCSYNIPMMAVSFGQIITHETENEFVYRGNNWPGESKIHIQRIQAASPPLSGSFDIQAYGHILKGLPAAVSAADLQFALQSLEGMGRISVTREGTCAGYAWNIKWRSTCGKQNLLQINDSNIIGEKANMTVTRIKEGGLFRQHVLGDLLRTPSQQPQVEVYVNGIPAKCSGDCGFTWDSNITPLVLAISPSQGSYEEGTILTIVGSGFSPSSAVTVSVGPVGCSLLSVDEKELKCQILNGSAGHAPVAVSMADVGLAQNVGGEEFYFVYQSQISHIWPDSGSIAGGTLLTLSGFGFNENSKVLVGNETCNVIEGDLNRITCRTPKKTEGTVDISVTTNGFQATARDAFSYNCLQTPIITDFSPKVRTILGEVNLTIKGYNFGNELTQNMAVYVGGKTCQILHWNFTDIRCLLPKLSPGKHDIYVEVRNWGFASTRDKLNSSIQYVLEVTSMFPQRGSLFGGTEITIRGFGFSTIPAENTVLLGSIPCNVTSSSENVIKCILHSTGNIFRITNNGKDSVHGLGYAWSPPVLNVSVGDTVAWHWQTHPFLRGIGYRIFSVSSPGSVIYDGKGFTSGRQKSTSGSFSYQFTSPGIHYYSSGYVDEAHSIFLQGVINVLPAETRHIPLHLFVGRSEATYAYGGPENLHLGSSVAGCLATEPLCSLNNTRVKNSKRLLFEVSSCFSPSISNITPSTGTVNELITIIGHGFSNLPWANKVTIGSYPCVVEESSEDSITCHIDPQNSMDVGIRETVTLTVYNLGTAINTLSNEFDRRFVLLPNIDLVLPNAGSTTGMTSVTIKGSGFAVSSAGVKVLMGHFPCKVLSVNYTAIECETSPAAQQLVDVDLLIHGVPAQCQGNCTFSYLESITPYITGVFPNSVIGSVKVLIEGEGLGTVLEDIAVFIGNQQFRAIEVNENNITALVTPLPVGHHSVSVVVGSKGLALGNLTVSSPPVASLSPTSGSIGGGTTLVITGNGFYPGNTTVTIGDEPCQIISINPNEVYCRTPAGTTGMVDVKIFVNTIAYPPLLFTYALEDTPFLRGIIPSRGPPGTEIEITGSNFGFEILEISVMINNIQCNVTMANDSVVQCIVGDHAGGTFPVMMHHKTKGSAMSTVVFEYPLNIQNINPSQGSFGGGQTMTVTGTGFNPQNSIILVCGSECAIDRLRSDYTTLLCEIPSNNGTGAEQACEVSVVNGKDLSQSMTPFTYAVSLTPLITAVSPKRGSTAGGTRLTVVGSGFSENMEDVHITIAEAKCDVEYSNKTHIICMTDAHTLSGWAPVCVHIRGVGMAKLDNADFLYVDAWSSNFSWGGKSPPEEGSLVVITKGQTILLDQSTPILKMLLIQGGTLIFDEADIELQAENILITDGGVLQIGTETSPFQHKAVITLHGHLRSPELPVYGAKTLAVREGILDLHGVPVPVTWTRLAHTAKAGERILILQEAVTWKPGDNIVIASTGHRHSQGENEKMTIASVSADGINITLSNPLNYTHLGITVTLPDGTLFEARAEVGILTRNILIRGSDNVEWNNKIPACPDGFDTGEFATQTCLQGKFGEEIGSDQFGGCVMFHAPVPGANMVTGRIEYVEVFHAGQAFRLGRYPIHWHLLGDLQFKSYVRGCAIHQAYNRAVTIHNTHHLLVERNIIYDIKGGAFFIEDGIEHGNILQYNLAVFVQQSTSLLNDDVTPAAFWVTNPNNTIRHNAVAGGTHFGFWYRMNNHPDGPSYDRNICQKRVPLGEFFNNTVHSQGWFGMWIFEEYFPMQTGSCTSTVPAPAIFNSLTTWNCQKGAEWVNGGALQFHNFVMVNNYEAGIETKRILAPYVGGWGETNGAVIKNAKIVGHLDELGMGSAFCTAKGLVLPFSEGLTVSSVHFMNFDRPNCVALGVTSISGVCNDRCGGWSAKFVDVQYSHTPNKAGFRWEHEMVMIDVDGSLTGHKGHTVIPHSSLLDPSHCTQEAEWSIGFPGSVCDASVSFHRLAFNQPSPVSLLEKDVVLSDSFGTSIIPFQKKRLTHMSGWMALIPNANHINWYFKGVDHITNISYTSTFYGFKEEDYVIISHNFTQNPDMFNIIDMRNGSSNPLNWNTSKNGDWHLEANTSTLYYLVSGRNDLHQSQLISGNLDPDVKDVVINFQAYCCILQDCFPVHPPSRKPIPKKRPATYNLWSNDSFWQSSRENNYTVPHPGANVIIPEGTWIVADIDMPSMERLIIWGVLELEDKYNVGAAESSYREVVLNATYISLQGGRLIGGWEDNPFKGDLKIVLRGNHTTQDWALPEGPNQGAKVLGVFGELDLHGIPHSIYKTKLSETAFAGSKVLSLMDAVDWQEGEEIVITTTSYDFHQTETRSIVKILHDHKILILNDSLSYTHFAEKYHVPGTGESYTLAADVGILSRNIKIVGEDYPGWSEDSFGARVLVGSFTENMMTFKGNARISNVEFYHSGQEGFRDSTDPRYAVTFLNLGQIQEHGSSYIRGCAFHHGFSPAIGVFGTDGLDIDDNIIHFTVGEGIRIWGNANRVRGNLIALSVWPGTYQNRKDLSSTLWHAAIEINRGTNTVLQNNVVAGFGRAGYRIDGEPCPGQFNPVEKWFDNEAHGGLYGIYMNQDGLPGCSLIQGFTIWTCWDYGIYFQTTESVHIYNVTLVDNGMAIFPMIYMPAAISHKISSKNVQIKSSLIVGSSPGFNCSDVLTNDDPNIELTAAHRSPRSPSGGRSGICWPTFASAHNMAPRKPHAGIMSYNAISGLLDISGSTFVGFKNVCSGETNVIFITNPLNEDLQHPIHVKNIKLVDTTEQSKIFIHRPDISKVNPSDCVDMVCDAKRKSFLRDIDGSFLGNAGSVIPQAEYEWDGNSQVGIGDYRIPKAMLTFLNGSRIPVTEKAPHKGIIRDSTCKYLPEWQSYQCFGMEYAMMVIESLDPDTETRRLSPVAIMGNGYVDLINGPQDHGWCAGYTCQRRLSLFHSIVALNKSYEVYFTGTSPQNLRLMLLNVDHNKAVLVGIFFSTLQRLDVYVNNLLVCPKTTIWNAQQKHCELNNHLYKDQFLPNLDSTVLGENYFDGTYQMLYLLVKGTIPVEIHTATVIFVSFQLSVATEDDFYTSHNLVKNLALFLKIPSDKIRISKIRGKSLRRKRSMGFIIEIEIGDPPIQFISNGTTGQMQLSELQEIAGSLGQAVILGNISSILGFNISSMSITNPLPSPSDSGWIKVTAQPVERSAFPVHHVAFVSSLLVITQPVAAQPGQPFPQQPSVKATDSDGNCVSVGITALTLRAILKDSNNNQVNGLSGNTTIPFSSCWANYTDLTPLRTGKNYKIEFILDNVVGVESRTFSLLAESVSSSGSSSSSNSKASTVGTYAQ

SEQ ID NO: 1781 - protein, 1377 aa, synthetic construct [sequence omitted]

SEQ ID NO: 1782 - protein, 1396 aa, synthetic construct
  REGION 1..1396: note = PLB1 (Q6P1J6) ECD
QIHTSPRKSTLEGQLWPETLKNSPFPCNPNKLGVNMPSKSVHSLKPSDIKFVAAIGNLEIPPDPGTGDLEKQDWTERPQQVCMGVMTVLSDIIRYFSPSVPMPVCHTGKRVIPHDGAEDLWIQAQELVRNMKENLQLDFQFDWKLINVFFSNASQCYLCPSAQQNGLAAGGVDELMGVLDYLQQEVPRAFVNLVDLSEVAEVSRQYHGTWLSPAPEPCNCSEETTRLAKVVMQWSYQEAWNSLLASSRYSEQESFTVVFQPFFYETTPSLHSEDPRLQDSTTLAWHLWNRMMEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVHYSPQNFTDNIGKALDILHAEVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYSAGGDGSLENVTTLPNILREFNRNLTGYAVGTGDANDTNAFLNQAVPGAKAEDLMSQVQTLMQKMKDDHRVNFHEDWKVITVLIGGSDLCDYCTDSNLYSAANFVHHLRNALDVLHREVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLY

SEQ ID NO: 1783 - protein, 408 aa, synthetic construct
  REGION 1..408: note = PLXDC1 (Q8IUK5) ECD
LSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGT

SEQ ID NO: 1784 - protein, 424 aa, synthetic construct
  REGION 1..424: note = PLXDC2 (Q6UX71) ECD
KPGDQILDWQYGVTQAFPHTEEEVEVDSHAYSHRWKRNLDFLKAVDTNRASVGQDSPEPRSFTDLLLDDGQDNNTQIEEDTDHNYYISRIYGPSDSASRDLWVNIDQMEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHA

SEQ ID NO: 1785 - protein, 1218 aa, synthetic construct
  REGION 1..1218: note = PLXNA1 (Q9UIW2) ECD
EAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLP

SEQ ID NO: 1786 - protein, 1203 aa, synthetic construct
  REGION 1..1203: note = PLXNA2 (O75051) ECD
MPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKERLQSCYQGEGNLELNWLLGKDVQCTKAPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLP

SEQ ID NO: 1787 - protein, 1201 aa, synthetic construct
  REGION 1..1201: note = PLXNA3 (P51805) ECD
NRPFRAFVVTDTTLTHLAVHRVTGEVFVGAVNRVFKLAPNLTELRAHVTGPVEDNARCYPPPSMRVCAHRLAPVDNINKLLLIDYAARRLVACGSIWQGICQFLRLDDLFKLGEPHHRKEHYLSGAQEPDSMAGVIVEQGQGPSKLFVGTAVDGKSEYFPTLSSRKLISDEDSADMFSLVYQDEFVSSQIKIPSDTLSLYPAFDIYYIYGFVSASFVYFLTLQLDTQQTLLDTAGEKFFTSKIVRMCAGDSEFYSYVEFPIGCSWRGVEYRLVQSAHLAKPGLLLAQALGVPADEDVLFTIFSQGQKNRASPPRQTILCLFTLSNINAHIRRRIQSCYRGEGTLALPWLLNKELPCINTPMQINGNFCGLVLNQPLGGLHVIEGLPLLADSTDGMASVAAYTYRQHSVVFIGTRSGSLKKVRVDGFQDAHLYETVPVVDGSPILRDLLFSPDHRHIYLLSEKQVSQLPVETCEQYQSCAACLGSGDPHCGWCVLRHRCCREGACLGASAPHGFAEELSKCVQVRVRPNNVSVTSPGVQLTVTLHNVPDLSAGVSCAFEAAAENEAVLLPSGELLCPSPSLQELRALTRGHGATRTVRLQLLSKETGVRFAGADFVFYNCSVLQSCMSCVGSPYPCHWCKYRHTCTSRPHECSFQEGRVHSPEGCPEILPSGDLLIPVGVMQPLTLRAKNLPQPQSGQKNYECVVRVQGRQQRVPAVRFNSSSVQCQNASYSYEGDEHGDTELDFSVVWDGDFPIDKPPSFRALLYKCWAQRPSCGLCLKADPRFNCGWCISEHRCQLRTHCPAPKTNWMHLSQKGTRCSHPRITQIHPLVGPKEGGTRVTIVGDNLGLLSREVGLRVAGVRCNSIPAEYISAERIVCEMEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNTCQVINDTAMLCKAPGIFLGRPQPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPA

SEQ ID NO: 1788 - protein, 1214 aa, synthetic construct
  REGION 1..1214: note = PLXNA4 (Q9HCM2) ECD
TLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKIRVDGPRGNALQYETVQVVDPGPVLRDMAFSKDHEQLYIMSERQLTRVPVESCGQYQSCGECLGSGDPHCGWCVLHNTCTRKERCERSKEPRRFASEMKQCVRLTVHPNNISVSQYNVLLVLETYNVPELSAGVNCTFEDLSEMDGLVVGNQIQCYSPAAKEVPRIITENGDHHVVQLQLKSKETGMTFASTSFVFYNCSVHNSCLSCVESPYRCHWCKYRHVCTHDPKTCSFQEGRVKLPEDCPQLLRVDKILVPVEVIKPITLKAKNLPQPQSGQRGYECILNIQGSEQRVPALRFNSSSVQCQNTSYSYEGMEINNLPVELTVVWNGHFNIDNPAQNKVHLYKCGAMRESCGLCLKADPDFACGWCQGPGQCTLRQHCPAQESQWLELSGAKSKCTNPRITEIIPVTGPREGGTKVTIRGENLGLEFRDIASHVKVAGVECSPLVDGYIPAEQIVCEMGEAKPSQHAGFVEICVAVCRPEFMARSSQLYYFMTLTLSDLKPSRGPMSGGTQVTITGTNLNAGSNVVVMFGKQPCLFHRRSPSYIVCNTTSSDEVLEMKVSVQVDRAKIHQDLVFQYVEDPTIVRIEPEWSIVSGNTPIAVWGTHLDLIQNPQIRAKHGGKEHINICEVLNATEMTCQAPALALGPDHQSDLTERPEEFGFILDNVQSLLILNKTNFTYYPNPVFEAFGPSGILELKPGTPIILKGKNLIPPVAGGNVKLNYTVLVGEKPCTVTVSDVQLLCESPNLIGRHKVMARVGGMEYSPGMVYIAPDSPLSLP

SEQ ID NO: 1789 - protein, 1471 aa, synthetic construct
  REGION 1..1471: note = PLXNB1 (O43157) ECD
LQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQ

SEQ ID NO: 1790 - protein, 1178 aa, synthetic construct
  REGION 1..1178: note = PLXNB2 (O15031) ECD
LRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVP

SEQ ID NO: 1791 - protein, 1211 aa, synthetic construct
  REGION 1..1211: note = PLXNB3 (Q9ULL4) ECD
HRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQ

SEQ ID NO: 1792 - protein, 910 aa, synthetic construct
  REGION 1..910: note = PLXNC1 (O60486) ECD
ADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENLENWLDISSGAKKCPKIQIIRSSKEKTTVTMVGSFSPRHSKCMVKNVDSSRELCQNKSQPNRTCTCSIPTRATYKDVSVVNVMFSFGSWNLSDRFNFTNCSSLKECPACVETGCAWCKSARRCIHPFTACDPSDYERNQEQCPVAVEKTSGGGRPKENKGNRTNQALQVFYIKSIEPQKVSTLGKSNVIVTGANFTRASNITMILKGTSTCDKDVIQVSHVLNDTHMKFSLPSSRKEMKDVCIQFDGGNCSSVGSLSYIALPHCSLIFPATTWISGGQNITMMGRNFDVIDNLIISHELKGNINVSEYCVATYCGFLAPSLKSSKVRTNVTVKLRVQDTYLDCGTLQYREDPRFTGYRVESEVDTELEVKIQKENDNFNISKKDIEITLFHGENGQLNCSFENITRNQDLTTILCKIKGIKTASTIANSSKKVRVKLGNLELYVEQESVPST

SEQ ID NO: 1793 - protein, 1225 aa, synthetic construct
  REGION 1..1225: note = PLXND1 (Q9Y4D7) ECD
LEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRCTLQQDCTNSSQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCMWSDGCRLRGPLQPMAGTCPAPEIHAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETA

SEQ ID NO: 1794 - protein, 443 aa, synthetic construct
  REGION 1..443: note = PMEL (P40967) ECD
KVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLV

SEQ ID NO: 1795 - protein, 439 aa, synthetic construct
  REGION 1..439: note = PODXL (O00592) ECD
SPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLLETVFHHVSQAGLELLTSGDLPTLASQSAGITASSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMP

SEQ ID NO: 1796 - protein, 468 aa, synthetic construct
  REGION 1..468: note = PODXL2 (Q9NZ53) ECD
GSDEPGPEGLTSTSLLDLLLPTGLEPLDSEEPSETMGLGAGLGAPGSGFPSEENEESRILQPPQYFWEEEEELNDSSLDLGPTADYVFPDLTEKAGSIEDTSQAQELPNLPSPLPKMNLVEPPWHMPPREEEEEEEEEEEREKEEVEKQEEEEEEELLPVNGSQEEAKPQVRDFSLTSSSQTPGATKSRHEDSGDQASSGVEVESSMGPSLLLPSVTPTTVTPGDQDSTSQEAEATVLPAAGLGVEFEAPQEASEEATAGAAGLSGQHEEVPALPSFPQTTAPSGAEHPDEDPLGSRTSASSPLAPGDMELTPSSATLGQEDLNQQLLEGQAAEAQSRIPWDSTQVICKDWSNLAGKNYIILNMTENIDCEVFRQHRGPQLLALVEEVLPRHGSGHHGAWHISLSKPSEKEQHLLMTLVGEQGVVPTQDVLSMLGDIRRSLEEIGIQNYSTTSSCQARASQVRSDYGT

SEQ ID NO: 1797 - protein, 57 aa, synthetic construct
  REGION 1..57: note = PRIMA1 (Q86XR5) ECD
EPQKSCSKVTDSCRHVCQCRPPPPLPPPPPPPPPPRLLSAPAPNSTSCPTEESWWSG

SEQ ID NO: 1798 - protein, 210 aa, synthetic construct
  REGION 1..210: note = PRLR (P16471) ECD
QLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMND

SEQ ID NO: 1799 - protein, 193 aa, synthetic construct
  REGION 1..193: note = PROCR (Q9UNN8) ECD
SQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTS

SEQ ID NO: 1800 - protein, 290 aa, synthetic construct
  REGION 1..290: note = PRSS8 (Q16651) ECD
AEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQG

SEQ ID NO: 1801 - protein, 914 aa, synthetic construct
  REGION 1..914: note = PRTG (Q2VWP7) ECD
FSELSFVKEPQDVTVTRKDPVVLDCQAHGEVPIKVTWLKNGAKMSENKRIEVLSNGSLYISEVEGRRGEQSDEGFYQCLAMNKYGAILSQKAHLALSTISAFEVQPISTEVHEGGVARFACKISSHPPAVITWEFNRTTLPMTMDRITALPTGVLQIYDVSQRDSGNYRCIAATVAHRRKSMEASLTVIPAKESKSFHTPTIIAGPQNITTSLHQTVVLECMATGNPKPIISWSRLDHKSIDVFNTRVLGNGNLMISDVRLQHAGVYVCRATTPGTRNFTVAMATLTVLAPPSFVEWPESLTRPRAGTARFVCQAEGIPSPKMSWLKNGRKIHSNGRIKMYNSKLVINQIIPEDDAIYQCMAENSQGSILSRARLTVVMSEDRPSAPYNVHAETMSSSAILLAWERPLYNSDKVIAYSVHYMKAEGLNNEEYQVVIGNDTTHYIIDDLEPASNYTFYIVAYMPMGASQMSDHVTQNTLEDVPLRPPEISLTSRSPTDILISWLPIPAKYRRGQVVLYRLSFRLSTENSIQVLELPGTTHEYLLEGLKPDSVYLVRITAATRVGLGESSVWTSHRTPKATSVKAPKSPELHLEPLNCTTISVRWQQDVEDTAAIQGYKLYYKEEGQQENGPIFLDTKDLLYTLSGLDPRRKYHVRLLAYNNIDDGYQADQTVSTPGCVSVRDRMVPPPPPPHHLYAKANTSSSIFLHWRRPAFTAAQIINYTIRCNPVGLQNASLVLYLQTSETHMLVQGLEPNTKYEFAVRLHVDQLSSPWSPVVYHSTLPEAPAGPPVGVKVTLIEDDTALVSWKPPDGPETVVTRYTILYASRKAWIAGEWQVLHREGAITMALLENLVAGNVYIVKISASNEVGEGPFSNSVELAVLPKETSESNQRPKRLDSADAKVYSGYYHLDQKSMT

SEQ ID NO: 1802 - protein, 123 aa, synthetic construct
  REGION 1..123: note = PTCRA (Q6ISU1) ECD
TPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGG

SEQ ID NO: 1803 - protein, 807 aa, synthetic construct [sequence omitted]

SEQ ID NO: 1804 - protein, 674 aa, synthetic construct
  REGION 1..674: note = PTK7 (Q13308) ECD
AIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQT

SEQ ID NO: 1805 - protein, 132 aa, synthetic construct
  REGION 1..132: note = PTPRA (P18433) ECD
NNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETP

SEQ ID NO: 1806 - protein, 1599 aa, synthetic construct
  REGION 1..1599: note = PTPRB (P23467) ECD
EPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIE

SEQ ID NO: 1807 - protein, 552 aa, synthetic construct
  REGION 1..552: note = PTPRC (P08575) ECD
QSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSK

(The sequence listing continues in the following parts.)

What is claimed is:

1. A tetrahedral antibody comprising a first domain, a second domain, a third domain, a fourth, a fifth domain, and a sixth domain which is formed by a first H1 polypeptide chain, a second H1 polypeptide chain, a first H2 polypeptide chain, a second H2 polypeptide chain, a first L1 polypeptide chain, a second L1 polypeptide chain, a first L2 polypeptide chain, and a second L2 polypeptide chain, wherein:

a) the first domain and the second domain are each a Fc domain of an IgG antibody;

b) the third domain and the fourth domain are each a Fab domain of an anti-CD19 antibody;

c) the fifth domain and the sixth domain are each a Fab domain of an anti-CD20 antibody;

d) the first and second H1 polypeptide chains comprise the amino acid sequence set forth in SEQ ID NO: 4775, the first and second H2 polypeptide chains comprise the amino acid sequence set forth in SEQ ID NO: 4730, the first and second L1 polypeptide chains comprise the amino acid sequence set forth in SEQ ID NO: 4819, and the first and second L2 polypeptide chains comprise the amino acid sequence set forth in SEQ ID NO: 4810;

e) the C-terminal portion of the first H1 polypeptide chain and the C-terminal portion of the first H2 polypeptide chain pair with one another to form the first domain;

f) the C-terminal portion of the second H1 polypeptide chain and the C-terminal portion of the second H2 polypeptide chain pair with one another to form the second domain;

g) the N-terminal portion of the first H1 polypeptide chain pairs with the first L1 polypeptide chain to form the third domain;

h) the N-terminal portion of the second H1 polypeptide chain pairs with the second L1 polypeptide chain to form the fourth domain;

i) the N-terminal portion of the first H2 polypeptide chain pairs with the first L2 polypeptide chain to form the fifth domain;

j) the N-terminal portion of the second H2 polypeptide chain pairs with the second L2 polypeptide chain to form the sixth domain; and k) the first H1 polypeptide chain dimerizes with the second H1 polypeptide chain at an ACE2 collectrin-like domain dimerizing polypeptide which is within each H1 chain between the C-terminal portion that pairs with the H2 polypeptide chain and the N-terminal portion that pairs with the L1 polypeptide chain.

2. One or more vector(s) comprising polynucleotides which encode polypeptides comprising the four polypeptide chains of claim 1, wherein each polynucleotide is operably linked to a promoter which directs expression of the polynucleotide in a host cell.

3. A host cell comprising the one or more vector(s) of claim 2.

4. A method of producing a tetrahedral antibody, the method comprising recombinantly expressing the polypeptide chains of claim 1 in a host cell.

5. A method of producing a tetrahedral antibody, the method comprising recombinantly expressing the one or more vector(s) of claim 2 in a host cell.

6. A pharmaceutical composition comprising the tetrahedral antibody of claim 1 and one or more pharmaceutically acceptable excipients.

7. A method of treating B cell cancer in a subject, the method comprising administering to the subject a therapeutically effective amount of the pharmaceutical composition of claim 6.

8. The host cell of claim 3, wherein the host cell is a Chinese hamster ovary (CHO) cell.

9. The host cell of claim 3, wherein the host cell is a Chinese hamster ovary (CHO) cell, wherein the one or more vector(s) are four different monocistronic DNA expression vectors, and wherein each of the four different monocistronic DNA expression vectors encodes one of the four polypeptide chains.

10. The method of claim 4, wherein the host cell is a Chinese hamster ovary (CHO) cell.

11. The method of claim 4, wherein the host cell is a Chinese hamster ovary (CHO) cell, wherein the polypeptide chains are recombinantly expressed from four different monocistronic DNA expression vectors, and wherein each of the four different monocistronic DNA expression vectors encodes one of the four polypeptide chains.

12. The method of claim 7, wherein the pharmaceutical composition is administered intravenously.

13. The method of claim 7, wherein the pharmaceutical composition is administered at a daily dosage of 0.01 to 10.0 mg/kg body weight of the subject.

* * * * *